US010619195B2

(12) United States Patent
Lamb et al.

(10) Patent No.: US 10,619,195 B2
(45) Date of Patent: Apr. 14, 2020

(54) GENE-EXPRESSION PROFILING WITH REDUCED NUMBERS OF TRANSCRIPT MEASUREMENTS

(71) Applicants: Massachusetts Institute of Technology, Cambridge, MA (US); THE BROAD INSTITUTE, INC., Cambridge, MA (US); DANA-FARBER CANCER INSTITUTE, INC., Boston, MA (US)

(72) Inventors: Justin Lamb, Cambridge, MA (US); Todd R. Golub, Newton, MA (US); Aravind Subramanian, Cambridge, MA (US); David D. Peck, Framingham, MA (US)

(73) Assignees: Massachusetts Institute Of Technology, Cambridge, MA (US); The Broad Institute, Inc., Cambridge, MA (US); Dana-Farber Cancer Institute, Inc., Boston, MA (US)

( * ) Notice: Subject to any disclaimer, the term of this patent is extended or adjusted under 35 U.S.C. 154(b) by 0 days.

(21) Appl. No.: 13/646,294

(22) Filed: Oct. 5, 2012

(65) Prior Publication Data

US 2013/0090254 A1 Apr. 11, 2013

Related U.S. Application Data

(63) Continuation-in-part of application No. PCT/US2011/031395, filed on Apr. 6, 2011, and a continuation-in-part of application No. PCT/US2011/031232, filed on Apr. 5, 2011.

(60) Provisional application No. 61/321,298, filed on Apr. 6, 2010, provisional application No. 61/321,385, filed on Apr. 6, 2010.

(51) Int. Cl.
*C12Q 1/6837* (2018.01)
*G16B 25/00* (2019.01)
*G16B 40/00* (2019.01)
*C12Q 1/6809* (2018.01)

(52) U.S. Cl.
CPC ......... *C12Q 1/6837* (2013.01); *C12Q 1/6809* (2013.01); *G16B 25/00* (2019.02); *G16B 40/00* (2019.02)

(58) Field of Classification Search
None
See application file for complete search history.

(56) References Cited

U.S. PATENT DOCUMENTS

| 6,873,914 | B2 | 3/2005 | Winfield et al. | |
|---|---|---|---|---|
| 7,542,959 | B2 | 6/2009 | Barnhill et al. | |
| 2003/0017481 | A1* | 1/2003 | Golub et al. | 435/6 |
| 2004/0210400 | A1 | 10/2004 | Konvicka | |
| 2004/0265874 | A1 | 12/2004 | Binder et al. | |
| 2005/0100929 | A1 | 5/2005 | Najarian | |
| 2005/0158756 | A1* | 7/2005 | Hare et al. | 435/6 |
| 2006/0074566 | A1* | 4/2006 | Najarian | 702/20 |
| 2007/0016390 | A1 | 1/2007 | Bernardo et al. | |
| 2007/0065844 | A1 | 3/2007 | Golub et al. | |
| 2007/0239415 | A2* | 10/2007 | Saito | 703/11 |
| 2008/0221395 | A1 | 9/2008 | Potts et al. | |
| 2009/0247415 | A1* | 10/2009 | Van Eijk | 506/5 |
| 2011/0263441 | A1* | 10/2011 | Golub et al. | 506/7 |
| 2013/0090254 | A1 | 4/2013 | Lamb et al. | |

FOREIGN PATENT DOCUMENTS

| EP | 2556185 | 8/2014 |
|---|---|---|
| WO | 02068579 | 9/2002 |
| WO | 2011127150 | 10/2011 |

OTHER PUBLICATIONS

Cao, "Recent developments in ligase-mediated amplification and detection" 22(1) Trends in Biotechnology 38-44 (2004).*
H. Ben Hsieh, et al., High Speed Detection of Circulating Tumor Cells, Biosensors and Bioelectronics (2006) vol. 21, p. 1893-1899.
K. Y. Yeung, et al., Principal Component Analysis for clustering Gene Expression Data, Bioinformatics (2001) vol. 17, No. 9, p. 763-774.
E. Capobianco, Model Validation for Gene Selection and Regulation Maps, Funct Integr Genomics (2008) vol. No. 2, p. 87-99.
W. G. Finn, Diagnostic Pathology and Laboratory Medicine in the Age of "omics", J. Mol. Diagn. (2007) vol. 9, No. 4, p. 431-436.
Hilario, et al., Approaches to Dimensionality Reduction in Proteomic Biomarker Studies, Brief Bioinform (2008) vol. 9, No. 2, p. 102-118.
Koren, et al., Robust Linear Dimensionality Reduction, IEEE Trans Vis Comput Graph. (2004) vol. 10, No. 4, p. 459-470.
Motsinger, et al., Multifactor Dimensionality Reduction: An Analysis Strategy for Modeling and Detecting Gene-Gene Interactions in Human Genetics and Pharmacogenomics Studies, Hum Genomics (2006) vol. 2, No. 5, p. 318-328.
D'Haeseleer P et al: Genetic network inference: from co-expression clustering to reverse engineering, Bioinformatics, Oxford University Press, Surrey, GB, vol. 16, No. 8, Aug. 1, 2000 (Aug. 1, 2000), pp. 707-726.

(Continued)

*Primary Examiner* — Nancy J Leith
(74) *Attorney, Agent, or Firm* — Melissa Hunter-Ensor; Wade Haaland; Greenberg Traurig, LLP

(57) ABSTRACT

The present invention provides compositions and methods for making and using a transcriptome-wide gene-expression profiling platform that measures the expression levels of only a select subset of the total number of transcripts. Because gene expression is believed to be highly correlated, direct measurement of a small number (for example, 1,000) of appropriately-selected transcripts allows the expression levels of the remainder to be inferred. The present invention, therefore, has the potential to reduce the cost and increase the throughput of full-transcriptome gene-expression profiling relative to the well-known conventional approaches that require all transcripts to be measured.

49 Claims, 8 Drawing Sheets

Specification includes a Sequence Listing.

(56) References Cited

OTHER PUBLICATIONS

Written Opinion dated Oct. 28, 2016, which issued during prosecution of Singapore Application No. 1020151626S.
Peck, et al. "A method for high-throughput gene expression signature analysis" Genome Biology, 2006, 7:R61, doe:10.1186/gb-2006-7-7-r61).
Subramanian, et al. "GSEA-P: a desktop application for Gene Set Enrichment Analysis" Bioinformatics, 2007, 23(23):3251-3253.
Dabney, A.R., et al. "Classificationof microarrays to nearest centroid" Bioinformatics, 2005, 21(22):4148-4154.
Examination Report for the corresponding European application No. 11766644.4, dated Jul. 16, 2018 (9 pages).
First Examination Report in corresponding Indian application No. 9134/CHENP/2012, received Jul. 9, 2018 (8 pages).
Examination Report in corresponding Canadian application No. 2795554, received Dec. 12, 2018 (3 pages).
Readhead et al., Expression-based Drug Screening of Neural Progenitor Cells from Individuals with Schizophrenia, Nature Communications, 2018, 1-13, vol. 9, Article No. 4412.

\* cited by examiner

A)

B)

GENE-EXPRESSION PROFILING WITH REDUCED NUMBERS OF TRANSCRIPT MEASUREMENTS

RELATED APPLICATIONS AND INCORPORATION BY REFERENCE

This application is a continuation-in-part application of international patent application Serial No. PCT/US2011/031395 filed 6 Apr. 2011, which published as PCT Publication No. WO 2011/127150 on 13 Oct. 2011, which claims benefit of U.S. provisional patent application Ser. No. 61/321,298 filed 6 Apr. 2010.

This application is also a continuation-in-part application of international patent application Serial No. PCT/US2011/031232 filed 5 Apr. 2011, which published as PCT Publication No. WO 2011/127042 on 13 Oct. 2011, which claims benefit of U.S. provisional patent application Ser. No. 61/321,385 filed 6 Apr. 2010.

FEDERAL FUNDING LEGEND

This invention was made with government support under Grant Nos. CA133834 and U54 6916636 awarded by the National Institutes of Health. The government has certain rights in the invention.

The foregoing applications, and all documents cited therein or during their prosecution ("appln cited documents") and all documents cited or referenced in the appln cited documents, and all documents cited or referenced herein ("herein cited documents"), and all documents cited or referenced in herein cited documents, together with any manufacturer's instructions, descriptions, product specifications, and product sheets for any products mentioned herein or in any document incorporated by reference herein, are hereby incorporated herein by reference, and may be employed in the practice of the invention. More specifically, all referenced documents are incorporated by reference to the same extent as if each individual document was specifically and individually indicated to be incorporated by reference.

SEQUENCE LISTING

The instant application contains a Sequence Listing which has been submitted in ASCII format via EFS-Web and is hereby incorporated by reference in its entirety. Said ASCII copy, created on Oct. 26, 2012, is named 44792011.txt and is 495,223 bytes in size.

FIELD OF THE INVENTION

The present invention relates to genomic informatics and gene-expression profiling. Gene-expression profiles provide complex molecular fingerprints regarding the relative state of a cell or tissue. Similarities in gene-expression profiles between organic states (i.e., for example, normal and diseased cells and/or tissues) provide molecular taxonomies, classification, and diagnostics. Similarities in gene-expression profiles resulting from various external perturbations (i.e., for example, ablation or enforced expression of specific genes, and/or small molecules, and/or environmental changes) reveal functional similarities between these perturbagens, of value in pathway and mechanism-of-action elucidation. Similarities in gene-expression profiles between organic (e.g. disease) and induced (e.g. by small molecule) states may identify clinically-effective therapies. Improvements described herein allow for the efficient and economical generation of full-transcriptome gene-expression profiles by identifying cluster centroid landmark transcripts that predict the expression levels of other transcripts within the same cluster.

BACKGROUND OF THE INVENTION

High-density, whole-transcriptome DNA microarrays are the method of choice for unbiased gene-expression profiling. These profiles have been found useful for the classification and diagnosis of disease, predicting patient response to therapy, exploring biological mechanisms, in classifying and elucidating the mechanisms-of-action of small molecules, and in identifying new therapeutics. van de Vijver et al., "A gene expression signature as a predictor of survival in breast cancer" *N Engl J Med* 347:1999-2009 (2002); Lamb et al., "A mechanism of cyclin D1 action encoded in the patterns of gene expression in human cancer" *Cell* 114:323-334 (2003); Glas et al., "Gene expression profiling in follicular lymphoma to assess clinical aggressiveness and to guide the choice of treatment" *Blood* 105:301-307 (2005); Burczynski et al., "Molecular classification of Crohn's disease and ulcerative colitis patients using transcriptional profiles in peripheral blood mononuclear cells" *J Mol Diagn* 8:51-61 (2006); Golub et al., "Molecular classification of cancer: class discovery and class prediction by gene expression monitoring" *Science* 286:531 (1999); Ramaswamy et al., "Multiclass cancer diagnosis using tumor gene expression signatures" *Proc Natl Acad Sci* 98: 15149 (2001); Lamb et al., "The Connectivity Map: using gene-expression signatures to connect small molecules, genes and disease" *Science* 313:1929 (2006). However, the overall success and widespread use of these methods is severely limited by the high cost and low throughput of existing transcriptome-analysis technologies. For example, using gene-expression profiling to screen for small molecules with desirable biological effects is practical only if one could analyze thousands of compounds per day at a cost dramatically below that of conventional microarrays.

What is needed in the art is a simple, flexible, cost-effective, and high-throughput transcriptome-wide gene-expression profiling solution that would allow for the analysis of many thousands of tissue specimens and cellular states induced by external perturbations. This would greatly accelerate the rate of discovery of medically-relevant connections encoded therein. Methods have been developed to rapidly assay the expression of small numbers of transcripts in large number of samples; for example, Peck et al., "A method for high-throughput gene expression signature analysis" *Genome Biol* 7:R61 (2006). If transcripts that faithfully predict the expression levels of other transcripts could be identified, it is conceivable that the measurement of a set of such 'landmark' transcripts using such moderate-multiplex assay methods could, in concert with an algorithm that calculates the levels of the non-landmark transcripts from those measurements, provide the full-transcriptome gene-expression analysis solution sought.

Citation or identification of any document in this application is not an admission that such document is available as prior art to the present invention.

SUMMARY OF THE INVENTION

The present invention is related to the field of genomic informatics and gene-expression profiling. Gene-expression profiles provide complex molecular fingerprints regarding the relative state of a cell or tissue. Similarities in gene-expression profiles between organic states (i.e., for example, normal and diseased cells and/or tissues) provide molecular taxonomies, classification, and diagnostics. Similarities in gene-expression profiles resulting from various external perturbations (i.e., for example, ablation or enforced expression of specific genes, and/or small molecules, and/or environmental changes) reveal functional similarities between these perturbagens, of value in pathway and mechanism-of-action elucidation. Similarities in gene-expression profiles between organic (e.g. disease) and induced (e.g. by small molecule) states may identify clinically-effective therapies. Improvements described herein allow for the efficient and economical generation of full-transcriptome gene-expression profiles by identifying cluster centroid landmark transcripts that predict the expression levels of other transcripts within the same cluster.

In one embodiment, the present invention contemplates a method for making a transcriptome-wide mRNA-expression profiling platform using sub-transcriptome numbers of transcript measurements which may comprise: a) providing: i) a first library of transcriptome-wide mRNA-expression data from a first collection of biological samples; ii) a second collection of biological samples; iii) a second library of transcriptome-wide mRNA-expression data from said second collection of biological samples; iv) a device capable of measuring transcript expression levels; b) performing computational analysis on said first library such that a plurality of transcript clusters are created, wherein the number of said clusters is substantially less than the total number of all transcripts; c) identifying a centroid transcript within each of said plurality of transcript clusters, thereby creating a plurality of centroid transcripts, said remaining transcripts being non-centroid transcripts; d) measuring the expression levels of at least a portion of transcripts from said second collection of biological samples with said device, wherein said portion of transcripts comprise transcripts identified as said centroid transcripts from said first library; e) determining the ability of said measurements of the expression levels of said centroid transcripts to infer the levels of at least a portion of transcripts from said second library, wherein said portion is comprised of non-centroid transcripts; f) selecting said centroid transcripts whose said expression levels have said ability to infer the levels of said portion of non-centroid transcripts. In one embodiment, the plurality of centroid transcripts is approximately 1000 centroid transcripts. In one embodiment, the device is selected from the group which may comprise a microarray, a bead array, a liquid array, or a nucleic-acid sequencer. In one embodiment, the computational analysis may comprise cluster analysis. In one embodiment, the method further may comprise repeating steps c) to f) until validated centroid transcripts for each of said plurality of transcript clusters are identified. In one embodiment, the plurality of clusters of transcripts are orthogonal. In one embodiment, the plurality of clusters of transcripts are non-overlapping. In one embodiment, the determining involves a correlation between said expression levels of said centroid transcripts and said expression levels of said non-centroid transcripts. In one embodiment, the expression levels of a set of substantially invariant transcripts are additionally measured with said device in said second collection of biological samples. In one embodiment, the measurements of said centroid transcripts made with said device, and said mRNA-expression data from said first and second libraries, are normalized with respect to the expression levels of a set of substantially invariant transcripts.

In one embodiment, the present invention contemplates a method for identifying a subpopulation of predictive transcripts within a transcriptome, which may comprise: a) providing; i) a first library of transcriptome-wide mRNA-expression data from a first collection of biological samples; ii) a second collection of biological samples or a second library of transcriptome-wide mRNA-expression data from said second collection of biological samples; iii) a device capable of measuring transcript expression levels; b) performing computational analysis on said first library such that a plurality of transcript clusters are created, wherein the number of said clusters is less than the total number of all transcripts in said first library; c) identifying a centroid transcript within each of said transcript clusters thereby creating a plurality of centroid transcripts, said remaining transcripts being non-centroid transcripts; d) processing transcripts from said second collection of biological samples on said device so as to measure expression levels of said centroid transcripts, and e) determining which of said plurality of centroid transcripts measured on said device predict the levels of said non-centroid transcripts in said second library of transcriptome-wide data. In one embodiment, the plurality of centroid transcripts is approximately 1000 centroid transcripts. In one embodiment, the device is selected from the group which may comprise a microarray, a bead array, a liquid array, or a nucleic-acid sequencer. In one embodiment, the computational analysis may comprise cluster analysis. In one embodiment, the determining involves a correlation between said centroid transcript and said non-centroid transcript. In one embodiment, the method further may comprise repeating steps c) to e).

In one embodiment, the present invention contemplates a method for identifying a subpopulation of approximately 1000 predictive transcripts within a transcriptome, which may comprise: a) providing: i) a first library of transcriptome-wide mRNA-expression data from a first collection of biological samples representing greater than 1000 different transcripts, and ii) transcripts from a second collection of biological samples; b) performing computational analysis on said first library such that a plurality of clusters of transcripts are created, wherein the number of said clusters is approximately 1000 and less than the total number of all transcripts in said first library; c) identifying a centroid transcript within each of said transcript clusters, said remaining transcripts being non-centroid transcripts; d) processing the transcripts from said second collection of biological samples so as to measure the expression levels of non-centroid transcripts, so as to create first measurements, and expression levels of centroid transcripts, so as to create second measurements; and e) determining which centroid transcripts based on said second measurements predict the levels of said non-centroid transcripts, based on said first measurements, thereby identifying a subpopulation of predictive transcripts within a transcriptome. In one embodiment, the method further may comprise a device capable of measuring the expression levels of said centroid transcripts. In one embodiment, the device is capable of measuring the expression levels of approximately 1000 of said centroid transcripts. In one embodiment, the computational analysis may comprise cluster analysis. In one embodiment, the determining involves a correlation between said centroid transcript and said non-centroid transcript. In one embodiment, the method further may comprise repeating steps c) to e).

In one embodiment, the present invention contemplates a method for predicting the expression level of a first population of transcripts by measuring the expression level of a second population of transcripts, which may comprise: a)

providing: i) a first heterogeneous population of transcripts which may comprise a second heterogeneous population of transcripts, said second population which may comprise a subset of said first population, ii) an algorithm capable of predicting the level of expression of transcripts within said first population which are not within said second population, said predicting based on the measured level of expression of transcripts within said second population; b) processing said first heterogeneous population of transcripts under conditions such that a plurality of different templates representing only said second population of transcripts is created; c) measuring the amount of each of said different templates to create a plurality of measurements; and d) applying said algorithm to said plurality of measurements, thereby predicting the level of expression of transcripts within said first population which are not within said second population. In one embodiment, the first heterogenous population of transcripts comprise a plurality of non-centroid transcripts. In one embodiment, the second heterogenous population of transcripts may comprise a plurality of centroid transcripts. In one embodiment, the method further may comprise a device capable of measuring the amount of approximately 1000 of said different templates. In one embodiment, the device is selected from the group which may comprise a microarray, a bead array, a liquid array, or a nucleic-acid sequencer. In one embodiment, the algorithm involves a dependency matrix.

In one embodiment, the present invention contemplates a method of assaying gene expression, which may comprise: a) providing: i) approximately 1000 different barcode sequences; ii) approximately 1000 beads, each bead which may comprise a homogeneous set of nucleic-acid probes, each set complementary to a different barcode sequence of said approximately 1000 barcode sequences; iii) a population of more than 1000 different transcripts, each transcript which may comprise a gene-specific sequence; iv) an algorithm capable of predicting the level of expression of unmeasured transcripts; b) processing said population of transcripts to create approximately 1000 different templates, each template which may comprise one of said approximately 1000 barcode sequences operably associated with a different gene-specific sequence, wherein said approximately 1000 different templates represents less than the total number of transcripts within said population; c) measuring the amount of each of said approximately 1000 different templates to create a plurality of measurements; and d) applying said algorithm to said plurality of measurements, thereby predicting the level of expression of unmeasured transcripts within said population. In one embodiment, the method further may comprise a device capable of measuring the amount of each of said approximately 1000 different templates. In one embodiment, the beads are optically addressed. In one embodiment, the processing may comprise ligation-mediated amplification. In one embodiment, the measuring may comprise detecting said optically addressed beads. In one embodiment, the measuring may comprise hybridizing said approximately 1000 different templates to said approximately 1000 beads through said nucleic-acid probes complementary to said approximately 1000 barcode sequences. In one embodiment, the measuring may comprise a flow cytometer. In one embodiment, the algorithm involves a dependency matrix.

In one embodiment, the present invention contemplates a composition which may comprise an amplified nucleic acid sequence, wherein said sequence may comprise at least a portion of a cluster centroid transcript sequence and a barcode sequence, wherein said composition further may comprise an optically addressed bead, and wherein said bead may comprise a capture probe nucleic-acid sequence hybridized to said barcode. In one embodiment, the barcode sequence is at least partially complementary to said capture probe nucleic acid. In one embodiment, the amplified nucleic-acid sequence is biotinylated. In one embodiment, the optically addressed bead is detectable with a flow cytometric system. In one embodiment, the flow cytometric system discriminates between approximately 500-1000 optically addressed beads.

In one embodiment, the present invention contemplates a method for creating a genome-wide expression profile, which may comprise: a) providing; i) a plurality of genomic transcripts derived from a biological sample; ii) a plurality of centroid transcripts which may comprise at least a portion of said genomic transcripts, said remaining genomic transcripts being non-centroid transcripts; b) measuring the expression level of said plurality of centroid transcripts; c) inferring the expression levels of said non-centroid transcripts from said centroid transcript expression levels, thereby creating a genome-wide expression profile. In one embodiment, the plurality of centroid transcripts comprise approximately 1,000 transcripts. In one embodiment, the measuring may comprise a device selected from the group which may comprise a microarray, a bead array, a liquid array, or a nucleic-acid sequencer. In one embodiment, the inferring involves a dependency matrix, the genome-wide expression profile identifies said biological sample as diseased. In one embodiment, the genome-wide expression profile identifies said biological sample as healthy. In one embodiment, the genome-wide expression profile provides a functional readout of the action of a perturbagen. In one embodiment, the genome-wide expression profile may comprise an expression profile suitable for use in a connectivity map. In one embodiment, the expression profile is compared with query signatures for similarities. In one embodiment, the genome-wide expression profile may comprise a query signature compatible with a connectivity map. In one embodiment, the query signature is compared with known genome-wide expression profiles for similarities.

In one embodiment, the present invention contemplates a kit, which may comprise: a) a first container which may comprise a plurality of centroid transcripts derived from a transcriptome; b) a second container which may comprise buffers and reagents compatible with measuring the expression level of said plurality of centroid transcripts within a biological sample; c) a set of instructions for inferring the expression level of non-centroid transcripts within said biological sample, based upon the expression level of said plurality of centroid transcripts. In one embodiment, the plurality of centroid transcripts is approximately 1,000 transcripts.

In one embodiment, the present invention contemplates a method for making a transcriptome-wide mRNA-expression profile, which may comprise: a) providing: i) a composition of validated centroid transcripts numbering substantially less than the total number of all transcripts; ii) a device capable of measuring the expression levels of said validated centroid transcripts; iii) an algorithm capable of substantially calculating the expression levels of transcripts not amongst the set of said validated centroid transcripts from expression levels of said validated centroid transcripts measured by said device and transcript cluster information created from a library of transcriptome-wide mRNA-expression data from a collection of biological samples; and iv) a biological sample; b) applying said biological sample to said device whereby expression levels of said validated centroid transcripts in said biological sample are measured; and c) applying said algorithm to said measurements thereby creating a transcriptome-wide mRNA expression profile. In one embodiment, the validated centroid transcripts comprise approximately 1,000 transcripts. In one embodiment, the device is selected from the group which may comprise a microarray, a bead array, a liquid array, or a nucleic-acid sequencer. In one embodiment, the expression levels of a set of substantially invariant transcripts are additionally measured in said biological sample. In one embodiment, the expression levels of said validated centroid transcripts are normalized with respect to said expression levels of said invariant transcripts.

In one embodiment, the present invention contemplates a method for making a transcriptome-wide mRNA-expression profiling platform which may comprise: a) providing: i) a first library of transcriptome-wide mRNA-expression data from a first collection of biological samples; ii) a second library of transcriptome-wide mRNA-expression data from a second collection of biological samples; iii) a device capable of measuring transcript expression levels; b) performing computational analysis on said first library such that a plurality of transcript clusters are created, wherein the number of said clusters is substantially less than the total number of all transcripts; c) identifying a centroid transcript within each of said plurality of transcript clusters, thereby creating a plurality of centroid transcripts; d) identifying a set of substantially invariant transcripts from said first library; e) measuring the expression levels of at least a portion of transcripts from said second collection of biological samples with said device, wherein said portion of transcripts comprise transcripts identified as said centroid transcripts and said invariant transcripts from said first library; f) determining the ability of said measurements of expression levels of said plurality of centroid transcripts to infer the levels of at least a portion of non-centroid transcripts from said second library. In one embodiment, the plurality of centroid transcripts is approximately 1000 centroid transcripts. In one embodiment, the device may comprise a genome-wide microarray. In one embodiment, the method further may comprise repeating steps c) to f) until validated centroid transcripts for each of said plurality of transcript clusters are identified. In one embodiment, the plurality of clusters of transcripts are orthogonal. In one embodiment, the plurality of clusters of transcripts are non-overlapping.

In one embodiment, the present invention contemplates a method for predicting transcript levels within a transcriptome, which may comprise: a) providing: i) a first library of transcriptome-wide mRNA-expression data from a first collection of biological samples; ii) a second library of transcriptome-wide mRNA-expression data from a second collection of biological samples; iii) a device capable of measuring transcript expression levels; b) performing computational analysis on said first library such that a plurality of transcript clusters are created, wherein the number of said clusters is less than the total number of all transcripts in said first library; c) identifying a centroid transcript within each of said transcript clusters thereby creating a plurality of centroid transcripts, said remaining transcripts being non-centroid transcripts; d) processing said second library transcripts on said device so as to measure expression levels of said centroid transcripts and e) determining which of said plurality of centroid transcripts measured on said device predict the levels of said non-centroid transcripts in said second library of transcriptome-wide data. In one embodiment, the plurality of centroid transcripts is approximately 1000 centroid transcripts. In one embodiment, the device is selected from the group which may comprise a microarray, a bead array, or a liquid array. In one embodiment, the computational analysis may comprise cluster analysis. In one embodiment, the identifying may comprise repeating steps c) to e). In one embodiment, the processing utilizes a flow cytometer. In one embodiment, the determining identifies a correlation between said centroid transcript and said non-centroid transcript.

In one embodiment, the present invention contemplates a method for making a transcriptome-wide mRNA-expression profiling platform which may comprise: a) providing: i) a first library of transcriptome-wide mRNA-expression data from a first collection of biological samples; ii) a second collection of biological samples; iii) a second library of transcriptome-wide mRNA-expression data from said second collection of biological samples; iv) a device capable of measuring transcript expression levels; b) performing computational analysis on said first library such that a plurality of transcript clusters are created, wherein the number of said clusters is substantially less than the total number of all transcripts; c) identifying a centroid transcript within each of said plurality of transcript clusters, thereby creating a plurality of centroid transcripts; d) measuring the expression levels of at least a portion of transcripts from said second collection of biological samples with said device, wherein said portion of transcripts comprise transcripts identified as said centroid transcripts from said first library; e) determining the ability of said measurements of the expression levels of said centroid transcripts to infer the levels of at least a portion of transcripts from said second library, wherein said portion is comprised of non-centroid transcripts. In one embodiment, the plurality of centroid transcripts is approximately 1000 centroid transcripts. In one embodiment, the device may comprise a microarray. In one embodiment, the device may comprise a bead array. In one embodiment, the device may comprise a liquid array. In a the method further may comprise repeating steps c) to e) until validated centroid transcripts for each of said plurality of transcript clusters are identified. In one embodiment, the plurality of clusters of transcripts are orthogonal. In one embodiment, the plurality of clusters of transcripts are non-overlapping. In one embodiment, the determining involves a correlation between said centroid transcripts and said non-centroid transcripts. In one embodiment, the expression levels of a set of substantially invariant transcripts are additionally measured with said device in said second collection of biological samples. In one embodiment, the measurements of said centroid transcripts made with said device, and said mRNA-expression data from said first and second libraries, are normalized with respect to the expression levels of a set of substantially invariant transcripts.

In one embodiment, the present invention contemplates a method for identifying a subpopulation of approximately 1000 predictive transcripts within a transcriptome, which may comprise: a) providing i) a first library of transcriptome-wide mRNA-expression data from a first collection of biological samples representing greater than 1000 different transcripts, and ii) transcripts from a second collection of biological samples; b) performing computational analysis on said first library such that a plurality of clusters of transcripts are created, wherein the number of said clusters is approximately 1000 and less than the total number of all transcripts in said first library; c) identifying a centroid transcript within each of said transcript clusters, said remaining transcripts being non-centroid transcripts; d) processing the transcripts from said second collection of biological samples so as to measure the expression levels of non-centroid transcripts, so as to create first measurements, and expression levels of centroid transcripts, so as to create second measurements; and e) determining which centroid transcripts based on said second measurements predict the levels of said non-centroid transcripts, based on said first measurements, thereby identifying a subpopulation of predictive transcripts within a transcriptome. In one embodiment, the method further may comprise a device capable of attaching said centroid transcripts. In one embodiment, the device attaches approximately 1000 of said centroid transcripts. In one embodiment, the computational analysis may comprise cluster analysis. In one embodiment, the identifying may comprise repeating steps c) to e). In one embodiment, the processing utilizes a flow cytometer. In one embodiment, the determining identifies a correlation between said centroid transcript and said non-centroid transcript.

In one embodiment, the present invention contemplates a method for predicting the expression level of a first population of transcripts by measuring the expression level of a second population of transcripts, which may comprise: a) providing; i) a first heterogeneous population of transcripts which may comprise a second heterogeneous population of transcripts, said second population which may comprise a subset of said first population, ii) an algorithm capable of predicting the level of expression of transcripts within said first population which are not within said second population, said predicting based on the measured level of expression of transcripts within said second population; b) processing said first heterogeneous population of transcripts under conditions such that a plurality of different templates representing only said second population of transcripts is created; c) measuring the amount of each of said different templates to create a plurality of measurements; and d) applying said algorithm to said plurality of measurements, thereby predicting the level of expression of transcripts within said first population which are not within said second population. In one embodiment, the first heterogenous population of transcripts comprise a plurality of non-centroid transcripts. In one embodiment, the second heterogenous population of transcripts may comprise a plurality of centroid transcripts. In one embodiment, the method further may comprise a device capable of attaching approximately 1000 of said centroid transcripts. In one embodiment, the measuring may comprise a flow cytometer. In one embodiment, the applying said algorithm identifies a correlation between said centroid transcript and said non-centroid transcript.

In one embodiment, the present invention contemplates a method of assaying gene expression, which may comprise: a) providing i) approximately 1000 different barcode sequences; ii) approximately 1000 beads, each bead which may comprise a homogeneous set of nucleic acid probes, each set complementary to a different barcode sequence of said approximately 1000 barcode sequences; iii) a population of more than 1000 different transcripts, each transcript which may comprise a gene specific sequence; iv) an algorithm capable of predicting the level of expression of unmeasured transcripts; b) processing said population of transcripts to create approximately 1000 different templates, each template which may comprise one of said approximately 1000 barcode sequences operably associated with a different gene specific sequence, wherein said approximately 1000 different templates represents less than the total number of transcripts within said population; c) measuring the amount of each of said approximately 1000 different templates to create a plurality of measurements; and d) applying said algorithm to said plurality measurements, thereby predicting the level of expression of unmeasured transcripts within said population. In one embodiment, the method further may comprise a device capable of attaching approximately 1000 of said centroid transcripts. In one embodiment, the processing may comprise ligation mediated amplification. In one embodiment, the beads are optically addressable. In one embodiment, the measuring may comprise detecting said optically addressable beads. In one embodiment, the applying said algorithm may comprise identifying a correlation between said measured transcripts and said unmeasured transcripts.

In one embodiment, the present invention contemplates a composition which may comprise an amplified nucleic acid sequence, wherein said sequence may comprise at least a portion of a cluster centroid landmark transcript sequence and a barcode sequence, wherein said composition further may comprise an optically addressable bead, and wherein said bead may comprise a capture probe nucleic acid sequence hybridized to said barcode. In one embodiment, the barcode sequence is at least partially complementary to said capture probe nucleic acid. In one embodiment, the optically addressable bead is color coded. In one embodiment, the amplified nucleic acid sequence is biotinylated. In one embodiment, the optically addressable bead is detectable with a flow cytometric system. In one embodiment, the flow cytometric system simultaneously differentiates between approximately 500-1000 optically addressable beads.

In one embodiment, the present invention contemplates a method for creating a genome-wide expression profile, which may comprise: a) providing; i) a plurality of genomic transcripts derived from a biological sample; and ii) a plurality of centroid transcripts which may comprise at least a portion of said genomic transcripts, said remaining genomic transcripts being non-centroid transcripts; b) measuring the expression of said plurality of centroid transcripts; c) inferring the expression levels of said non-centroid transcripts from said centroid transcript expression, thereby creating a genome wide expression profile. In one embodiment, the plurality of centroid transcripts comprise approximately 1,000 transcripts. In one embodiment, the genome-wide expression profile identifies said biological sample as diseased. In one embodiment, the genome-wide expression profile identifies said biological sample as healthy. In one embodiment, the genome-wide expression profile may comprise a query signature compatible with a connectivity map. In one embodiment, the query signature is compared with known genome-wide expression profiles for similarities.

In one embodiment, the present invention contemplates a method for identifying a subpopulation of predictive transcripts within a transcriptome, which may comprise: a) providing i) a device to measure the expression level of transcripts, ii) a first library of transcriptome-wide mRNA-expression data from a first collection of biological samples, and iii) transcripts from a second collection of biological samples; b) performing computational analysis on said first library such that a plurality of clusters of transcripts are created, wherein the number of said clusters is less than the total number of all transcripts in said first library; c) identifying a centroid transcript within each of said transcript clusters, said remaining transcripts being non-centroid transcripts; d) processing the transcripts from said second collection of biological samples so as to measure, with said device, the expression levels of non-centroid transcripts, so as to create first measurements, and expression levels of centroid transcripts, so as to create second measurements; and e) determining which centroid transcripts based on said second measurements predict the levels of said non-centroid transcripts, based on said first measurements, thereby identifying a subpopulation of predictive transcripts within a transcriptome. In one embodiment, the device may comprise a microarray. In one embodiment, the computational analysis may comprise cluster analysis. In one embodiment, the identifying may comprise an iterative validation algorithm. In one embodiment, the processing utilizes a cluster dependency matrix. In one embodiment, the determining identifies a dependency matrix between said centroid transcript and said non-centroid transcript.

In one embodiment, the present invention contemplates a method for identifying a subpopulation of approximately 1000 predictive transcripts within a transcriptome, which may comprise: a) providing i) a device to measure the expression level of transcripts, ii) a first library of transcriptome-wide mRNA-expression data from a first collection of biological samples representing greater than 1000 different transcripts, and iii) transcripts from a second collection of biological samples; b) performing computational analysis on said first library such that a plurality of clusters of transcripts are created, wherein the number of said clusters is approximately 1000 and less than the total number of all transcripts in said first library; c) identifying a centroid transcript within each of said transcript clusters, said remaining transcripts being non-centroid transcripts; d) processing the transcripts from said second collection of biological samples so as to measure, with said device, the expression levels of non-centroid transcripts, so as to create first measurements, and expression levels of centroid transcripts, so as to create second measurements; and e) determining which centroid transcripts based on said second measurements predict the levels of said non-centroid transcripts, based on said first measurements, thereby identifying a subpopulation of predictive transcripts within a transcriptome. In one embodiment, the device may comprise a microarray. In one embodiment, the computational analysis may comprise cluster analysis. In one embodiment, the identifying may comprise an iterative validation algorithm. In one embodiment, the processing utilizes a cluster dependency matrix. In one embodiment, the determining identifies a dependency matrix between said centroid transcript and said non-centroid transcript.

In one embodiment, the present invention contemplates a method for predicting the expression level of a first population of transcripts by measuring the expression level of a second population of transcripts, which may comprise: a) providing i) a first heterogeneous population of transcripts which may comprise a second heterogeneous population of transcripts, said second population which may comprise a subset of said first population, ii) a device, iii) an algorithm capable of predicting the level of expression of transcripts within said first population which are not within said second population, said predicting based on the measured level of expression of transcripts within said second population; b) processing said first heterogeneous population of transcripts under conditions such that a plurality of different templates representing only said second population of transcripts is created; c) measuring the amount of each of said different templates with said device to create a plurality of measurements; and d) applying said algorithm to said plurality of measurements, thereby predicting the level of expression of transcripts within said first population which are not within said second population. In one embodiment, the first heterogenous population of transcripts comprise a plurality of non-centroid transcripts. In one embodiment, the second heterogenous population of transcripts may comprise a plurality of centroid transcripts. In one embodiment, the device may comprise a microarray. In one embodiment, the processing may comprise computations selected from the group consisting of dimensionality reduction and cluster analysis. In one embodiment, the applying said algorithm identifies a dependency matrix between said centroid transcript and said non-centroid transcript.

In one embodiment, the present invention contemplates a method of assaying gene expression, which may comprise: a) providing i) approximately 1000 different barcode sequences; ii) approximately 1000 beads, each bead which may comprise a homogeneous set of nucleic acid probes, each set complementary to a different barcode sequence of said approximately 1000 barcode sequences; iii) a population of more than 1000 different transcripts, each transcript which may comprise a gene specific sequence; iv) a device; and v) an algorithm capable of predicting the level of expression of unmeasured transcripts; b) processing said population of transcripts to create approximately 1000 different templates, each template which may comprise one of said approximately 1000 barcode sequences operably associated with a different gene specific sequence, wherein said approximately 1000 different templates represents less than the total number of transcripts within said population; c) measuring the amount of each of said approximately 1000 different templates with said device to create a plurality of measurements; and d) applying said algorithm to said plurality measurements, thereby predicting the level of expression of unmeasured transcripts within said population. In one embodiment, the device may comprise a microarray. In one embodiment, the processing may comprise ligation mediated amplification. In one embodiment, the beads are optically addressable. In one embodiment, the measuring may comprise detecting said optically addressable beads. In one embodiment, the applying said algorithm identifies a dependency matrix between said measured transcripts and said unmeasured transcripts.

In one embodiment, the present invention contemplates a method for making a transcriptome-wide mRNA-expression profiling platform which may comprise a) providing a library of transcriptome-wide mRNA-expression data from a first collection of biological samples; b) performing computational analysis on said library such that a plurality of (orthogonal/non-overlapping) clusters of transcripts are created, wherein the number of said clusters is substantially less than the total number of all transcripts; c) identifying a centroid transcript within each of said transcript clusters; d) identifying a set of transcripts from said transcriptome-wide mRNA-expression-data library whose levels are substantially invariant across said first collection of biological samples; e) providing a device to measure (simultaneously) the levels of at least a portion of said centroid transcripts and said invariant transcripts; f) determining the ability of said measurements of centroid-transcript levels made using said device to represent the levels of other transcripts within its cluster from a second collection of biological samples; and g) repeating steps c) to f) until validated centroid transcripts for each of said plurality of transcript clusters are identified.

In one embodiment, the present invention contemplates a method for using a transcriptome-wide mRNA-expression profiling platform: a) providing: i) a composition of validated centroid transcripts numbering substantially less than the total number of all transcripts; ii) a device capable of measuring the levels of said validated centroid transcripts; iii) an algorithm capable of substantially calculating the levels of transcripts not amongst the set of said validated centroid transcripts from levels of said validated centroid transcripts measured by said device and transcript cluster information created from a library of transcriptome-wide mRNA-expression data from a collection of biological samples; and iv) a biological sample; b) applying said biological sample to said device whereby levels of said validated centroid transcripts in said biological sample are measured; and c) applying said algorithm to said measurements thereby creating a transcriptome-wide mRNA expression profile.

The present invention is also related to compositions and methods for the detection of analytes. Analytes capable of detection by this invention include, but are not limited to, nucleic acids, proteins, peptides, and/or small organic molecules (i.e., for example, inorganic and/or organic). Any particular analyte may be detected and/or identified from a sample containing a plurality of other analytes. Further, the invention provides for a capability of simultaneously detecting and/or identifying all of the plurality of analytes contained within a sample (i.e., for example, a biological sample).

In one embodiment, the present invention contemplates a method, which may comprise: a) providing: i) a sample which may comprise a plurality of analytes; ii) a plurality of solid substrate populations, wherein each of the solid substrate populations comprise a plurality of subsets, and wherein each subset is present in an unequal proportion from every other subset in the same solid substrate population; iii) a plurality of capture probes capable of attaching to said plurality of analytes, wherein each subset may comprise a different capture probe; vi) a means for detecting said plurality of subsets that is capable of creating a multimodal intensity distribution pattern; b) detecting said plurality of subsets with said means, wherein a multimodal intensity distribution pattern is created; c) identifying said plurality of analytes from said multimodal distribution pattern. In one embodiment, the sample may be selected from the group which may comprise a biological sample, a soil sample, or a water sample. In one embodiment, the plurality of analytes may be selected from the group which may comprise nucleic acids, proteins, peptides, drugs, small molecules, biological receptors, enzymes, antibodies, polyclonal antibodies, monoclonal antibodies, or Fab fragments. In one embodiment, the solid substrate population may comprise a beadset population. In one embodiment, the unequal proportions comprise two subsets in an approximate ratio of 1.25:0.75. In one embodiment, the unequal proportions comprise three subsets in an approximate ratio of 1.25:1.00:0.75. In one embodiment, the unequal proportions comprise four subsets in an approximate ratio of 1.25:1.00:0.75:0.50. In one embodiment, the unequal proportions comprise five subsets in an approximate ratio of 1.50:1.25:1.00:0.75:0.50. In one embodiment, the unequal proportions comprise six subsets in an approximate ratio of 1.75:1.50:1.25:1.00:0.75:0.50. In one embodiment, the unequal proportions comprise seven subsets in an approximate ratio of 2.00:1.75:1.50:1.25:1.00:0.75:0.50. In one embodiment, the unequal proportions comprise eight subsets in an approximate ratio of 2.00:1.75:1.50:1.25:1.00:0.75:0.50:0.25. In one embodiment, the unequal proportions comprise nine subsets in an approximate ratio of 2.25:2.00:1.75:1.50:1.25:1.00:0.75:0.50:0.25. In one embodiment, the unequal proportions comprise ten subsets in an approximate ratio of 2.5:2.25:2.00:1.75:1.50:1.25:1.00:0.75:0.50:0.25.

In one embodiment, the present invention contemplates a method, which may comprise: a) providing: i) a solid substrate population which may comprise a first subset and a second subset, wherein the first subset is present in a first proportion and the second subset is present in a second proportion; ii) a first analyte attached to said first subset; iii) a second analyte attached to said second subset; vi) a means for detecting said first subset and second subset that is capable of creating a multimodal intensity distribution pattern; b) detecting said first subset and said second subset with said means, wherein a multimodal intensity distribution pattern is created; and c) identifying said first analyte and said second analyte from said multimodal distribution pattern.

In one embodiment, the solid substrate population may comprise a label. In one embodiment, the label may comprise a mixture of at least two different fluorophores. In one embodiment, the first proportion is different from the second proportion. In one embodiment, the first analyte is attached to the first subset with a first capture probe. In one embodiment, the second analyte is attached to the second subset with a second capture probe. In one embodiment, the multimodal intensity distribution pattern may comprise a first peak corresponding to the first subset. In one embodiment, the multimodal intensity distribution pattern may comprise a second peak corresponding to the second subset.

In one embodiment, the present invention contemplates a method, which may comprise: a) providing: i) a solid substrate population which may comprise a plurality of subsets; ii) a sample which may comprise a plurality of analytes, wherein at least one portion of the plurality of analytes comprise related analytes; and iii) a means for detecting said subsets that is capable of creating a multimodal intensity distribution pattern; b) attaching each of the related analyte portions to one of the plurality of subsets; c) detecting said plurality of subsets with said means, wherein a multimodal intensity distribution pattern is created; and d) identifying said related analytes from said multimodal distribution pattern. In one embodiment, the related analytes comprise linked genes.

In one embodiment, the present invention contemplates a method, which may comprise: a) providing: i) a solid substrate population which may comprise a plurality of subsets; ii) a sample which may comprise a plurality of analytes, wherein at least one portion of the plurality of analytes comprise rare event analytes; and iii) a means for detecting said subsets that is capable of creating a multimodal intensity distribution pattern; b) attaching a portion of said plurality of analytes which may contain one or more of the rare event analytes to one of the plurality of subsets; c) detecting said plurality of subsets with said means, wherein a multimodal intensity distribution pattern is created; and d) determining if said rare event analytes occur in said multimodal distribution pattern. In one embodiment, the rare event analyte portion is present in approximately less than 0.01% of said sample. In one embodiment, the rare event analyte may comprise a small molecule or drug. In one embodiment, the rare event analyte may comprise a nucleic acid mutation. In one embodiment, the rare event analyte may comprise a diseased cell. In one embodiment, the rare event analyte may comprise an autoimmune antibody. In one embodiment, the rare event analyte may comprise a microbe.

In one embodiment, the present invention contemplates a method, which may comprise: a) providing: i) a solid substrate population which may comprise a plurality of subsets; ii) a sample which may comprise a first labeled analyte and a second labeled analyte; and iii) a means for detecting said subsets that is capable of creating a multimodal intensity distribution pattern; b) attaching the first and second labeled analytes in an unequal proportion to one of the plurality of subsets; c) detecting said plurality of subsets with said means, wherein a multimodal intensity distribution pattern is created; and d) identifying said first and second labeled analytes from said multimodal distribution pattern. In one embodiment, the first labeled analyte may comprise a normal cell. In one embodiment, the second labeled analyte may comprise a tumor cell. In one embodiment, the multimodal intensity distribution pattern may comprise a first peak corresponding to the first labeled analyte. In one embodiment, the multimodal intensity distribution pattern may comprise a second peak corresponding to the second labeled analyte. In one embodiment, the unequal proportion is equivalent to a ratio of the first and second peaks.

Accordingly, it is an object of the invention not to encompass within the invention any previously known product, process of making the product, or method of using the product such that Applicants reserve the right and hereby disclose a disclaimer of any previously known product, process, or method. It is further noted that the invention does not intend to encompass within the scope of the invention any product, process, or making of the product or method of using the product, which does not meet the written description and enablement requirements of the USPTO (35 U.S.C. § 112, first paragraph) or the EPO (Article 83 of the EPC), such that Applicants reserve the right and hereby disclose a disclaimer of any previously described product, process of making the product, or method of using the product.

It is noted that in this disclosure and particularly in the claims and/or paragraphs, terms such as "comprises", "comprised", "comprising" and the like can have the meaning attributed to it in U.S. Patent law; e.g., they can mean "includes", "included", "including", and the like; and that terms such as "consisting essentially of" and "consists essentially of" have the meaning ascribed to them in U.S. Patent law, e.g., they allow for elements not explicitly recited, but exclude elements that are found in the prior art or that affect a basic or novel characteristic of the invention.

These and other embodiments are disclosed or are obvious from and encompassed by, the following Detailed Description.

BRIEF DESCRIPTION OF THE FIGURES

The following detailed description, given by way of example, but not intended to limit the invention solely to the specific embodiments described, may best be understood in conjunction with the accompanying drawings.

FIG. 6A: Plots of normalized expression levels for a representative validated transcript/probe pair (blue, 218039_at:NUSAP1) and a representative failed transcript/probe pair (orange, 217762_s_at:RAB31).

FIG. 6B: Histogram showing normalized expression levels for the validated transcript/probe pair from FIG. 6A (blue arrow) and its associated non-centroid transcripts (blue bars); and the failed transcript/probe pair from FIG. 6A (orange arrow) and its associated non-centroid transcripts (orange bars). Red crosses mark non-correlation of gene-expression levels.

DETAILED DESCRIPTION OF THE INVENTION

Figure 1:
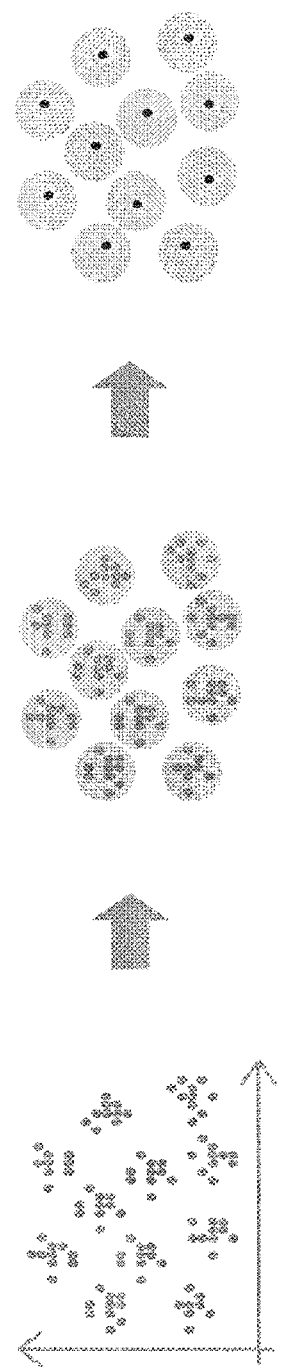
FIG. 1 presents exemplary simulated data depicting the clustering of PCA loadings of transcripts (purple dots) in the eigenspace by k-means to identify k distinct clusters (gray circles). The transcript closest to the mean of the cluster was selected as the 'cluster centroid landmark transcript' (single red dots).

The term "device" as used herein, refers to any composition capable of measuring expression levels of transcripts. For example, a device may comprise a solid planar substrate capable of attaching nucleic acids (i.e., an oligonucleotide microarray). Alternatively, a device may comprise a solution-based bead array, wherein nucleic acids are attached to beads and detected using a flow cytometer. Alternatively, a device may comprise a nucleic-acid sequencer. In other examples, a device may comprise a plurality of cluster centroid landmark transcripts as contemplated by the present invention.

The term "capture probe" as used herein, refers to any molecule capable of attaching and/or binding to a nucleic acid (i.e., for example, a barcode nucleic acid). For example, a capture probe may be an oligonucleotide attached to a bead, wherein the oligonucleotide is at least partially complementary to another oligonucleotide. Alternatively, a capture probe may comprise a polyethylene glycol linker, an antibody, a polyclonal antibody, a monoclonal antibody, an Fab fragment, a biological receptor complex, an enzyme, a hormone, an antigen, and/or a fragment or portion thereof.

The term "LMF" as used herein, refers to an acronym for any method that combines ligation-mediated amplication, optically-addressed and barcoded microspheres, and flow cytometric detection. See Peck et al., "A method for high-throughput gene expression signature analysis" *Genome Biol* 7:R61 (2006).

The term "transcript" as used herein, refers to any product of DNA transcription, generally characterized as mRNA. Expressed transcripts are recognized as a reliable indicator of gene expression.

The term "gene-expression profile" as used herein, refers to any dataset representing the expression levels of a significant portion of genes within the genome (i.e., for example, a transcriptome).

The term "centroid transcript" as used herein, refers to any transcript that is within the center portion, or is representative of, a transcript cluster. Further, the expression level of a centroid transcript may predict the expression levels of the non-centroid transcripts within the same cluster.

The term "non-centroid transcript" as used herein, refers to any transcript in a transcript cluster that is not a centroid transcript. The expression level of a non-centroid transcript may be predicted (e.g., inferred) by the expression levels of centroid transcripts.

The term "cluster centroid landmark transcript" as used herein, refers to any transcript identified as a centroid transcript, the expression level of which predicts (e.g., infers) the expression levels of non-centroid transcripts within the same cluster, and optionally may contribute to prediction of the expression levels of non-centroid transcripts in other clusters.

The term "computational analysis" as used herein, refers to any mathematical process that results in the identification of transcript clusters, wherein the transcripts are derived from a transcriptome. For example, specific steps in a computational analysis may include, but are not limited to, dimensionality reduction and/or cluster analysis.

The term "dependency matrix" as used herein, refers to a table of weights (i.e., factors) relating the expression levels of a plurality of cluster centroid landmark transcripts to the expression levels of non-centroid transcripts generated by a mathematical analysis (i.e., for example, regression) of a library of transcriptome-wide gene-expression profiles. Cluster dependency matrices may be produced from a heterogeneous library of gene-expression profiles or from libraries of gene-expression profiles from specific tissues, organs, or disease classes.

The term "algorithm capable of predicting the level of expression of transcripts" as used herein, refers to any mathematical process that calculates the expression levels of non-centroid transcripts given the expression levels of cluster centroid landmark transcripts and a dependency matrix.

The term "invariant transcript" as used herein, refers to any transcript that remains at approximately the sample level regardless of cell or tissue type, or the presence of a perturbating agent (i.e., for example, a perturbagen). Invariant transcripts, or sets thereof, may be useful as an internal control for normalizing gene-expression data.

The term "moderate-multiplex assay platform" as used herein, refers to any technology capable of producing simultaneous measurements of the expression levels of a fraction of the transcripts in a transcriptome (i.e., for example, more than approximately 10 and less than approximately 2,000).

The term "Connectivity Map" as used herein, refers to a public database of transcriptome-wide gene-expression profiles derived from cultured human cells treated with a plurality of perturbagens, and pattern-matching algorithms for the scoring and identification of significant similarities between those profiles and external gene-expression data, as described by Lamb et al., "The Connectivity Map: using gene-expression signatures to connect small molecules, genes and disease". *Science* 313:1929 (2006). Build02 of the Connectivity Map contains 7,056 full-transcriptome gene-expression profiles generated with Affymetrix high-density oligonucleotide microarrays representing the biological effects of 1,309 small-molecule perturbagens, and is available at broadinstitute.org/cmap.

The term "query signature" as used herein, refers to any set of up- and down-regulated genes between two cellular states (e.g., cells treated with a small molecule versus cells treated with the vehicle in which the small molecule is dissolved) derived from a gene-expression profile that is suitable to query Connectivity Map. For example, a 'query signature' may comprise a list of genes differentially expressed in a distinction of interest; (e.g., disease versus normal), as opposed to an 'expression profile' that illustrates all genes with their respective expression levels.

The term "connectivity score" as used herein, refers to a relative measure of the similarity of the biological effects of a perturbagen used to generate a query signature with those of a perturbagen represented in the Connectivity Map based upon the gene-expression profile of a single treatment with that perturbagen. For example, one would expect every treatment instances with vorinostat, a known histone deacetylase (HDAC) inhibitor, to have a high connectivity score with a query signature generated from the effects of treatments with a panel of HDAC inhibitors.

The term "enrichment score" as used herein, refers to a measure of the similarity of the biological effects of a perturbagen used to generate a query signature with those of a perturbagen represented in the Connectivity Map based upon the gene-expression profiles of multiple independent treatments with that perturbagen.

The term "template" as used herein, refers to any stable nucleic acid structure that represents at least a portion of a cluster centroid landmark gene transcript nucleic acid sequence. The template may serve to allow the generation of a complementary nucleic acid sequence.

The term "derived from" as used herein, refers to the source of a biological sample, wherein the sample may comprise a nucleic acid sequence. In one respect, a sample or sequence may be derived from an organism or particular species. In another respect, a sample or sequence may be derived from (i.e., for example, a smaller portion and/or fragment) a larger composition or sequence.

The term, "purified" or "isolated", as used herein, may refer to a component of a composition that has been subjected to treatment (i.e., for example, fractionation) to remove various other components. Where the term "substantially purified" is used, this designation will refer to a composition in which a nucleic acid sequence forms the major component of the composition, such as constituting about 50%, about 60%, about 70%, about 80%, about 90%, about 95% or more of the composition (i.e., for example, weight/weight and/or weight/volume). The term "purified to homogeneity" is used to include compositions that have been purified to "apparent homogeneity" such that there is single nucleic acid species (i.e., for example, based upon SDS-PAGE or HPLC analysis). A purified composition is not intended to mean that some trace impurities may remain.

As used herein, the term "substantially purified" refers to molecules, such as nucleic acid sequences, that are removed from their natural environment, isolated or separated, and are at least 60% free, preferably 75% free, and more preferably 90% free from other components with which they are naturally associated. An "isolated polynucleotide" is therefore a substantially purified polynucleotide.

"Nucleic acid sequence" and "nucleotide sequence" as used herein refer to an oligonucleotide or polynucleotide, and fragments or portions thereof, and to DNA or RNA of genomic or synthetic origin which may be single- or double-stranded, and represent the sense or antisense strand.

The term "an isolated nucleic acid", as used herein, refers to any nucleic acid molecule that has been removed from its natural state (e.g., removed from a cell and is, in a preferred embodiment, free of other genomic nucleic acid).

The term "portion or fragment" when used in reference to a nucleotide sequence refers to smaller subsets of that nucleotide sequence. For example, such portions or fragments may range in size from 5 nucleotide residues to the entire nucleotide sequence minus one nucleic acid residue.

The term "small organic molecule" as used herein, refers to any molecule of a size comparable to those organic molecules generally used in pharmaceuticals. The term excludes biological macromolecules (e.g., proteins, nucleic acids, etc.). Preferred small organic molecules range in size from approximately 10 Da up to about 5000 Da, more preferably up to 2000 Da, and most preferably up to about 1000 Da.

The term "sample" as used herein is used in its broadest sense and includes environmental and biological samples. Environmental samples include material from the environment such as soil and water. Biological samples may be animal, including, human, fluid (e.g., blood, plasma and serum), solid (e.g., stool), tissue, liquid foods (e.g., milk), and solid foods (e.g., vegetables). For example, a pulmonary sample may be collected by bronchoalveolar lavage (BAL) which may comprise fluid and cells derived from lung tissues. A biological sample may comprise a cell, tissue extract, body fluid, chromosomes or extrachromosomal elements isolated from a cell, genomic DNA (in solution or bound to a solid support such as for Southern blot analysis), RNA (in solution or bound to a solid support such as for Northern blot analysis), cDNA (in solution or bound to a solid support) and the like.

The term "functionally equivalent codon", as used herein, refers to different codons that encode the same amino acid. This phenomenon is often referred to as "degeneracy" of the genetic code. For example, six different codons encode the amino acid arginine.

A "variant" of a nucleotide is defined as a novel nucleotide sequence which differs from a reference oligonucleotide by having deletions, insertions and substitutions. These may be detected using a variety of methods (e.g., sequencing, hybridization assays etc.).

A "deletion" is defined as a change in a nucleotide sequence in which one or more nucleotides are absent relative to the native sequence.

An "insertion" or "addition" is that change in a nucleotide sequence which has resulted in the addition of one or more nucleotides relative to the native sequence. A "substitution" results from the replacement of one or more nucleotides by different nucleotides or amino acids, respectively, and may be the same length of the native sequence but having a different sequence.

The term "derivative" as used herein, refers to any chemical modification of a nucleic acid. Illustrative of such modifications would be replacement of hydrogen by an alkyl, acyl, or amino group. For example, a nucleic acid derivative would encode a polypeptide which retains essential biological characteristics.

As used herein, the terms "complementary" or "complementarity" are used in reference to "polynucleotides" and "oligonucleotides" (which are interchangeable terms that refer to a sequence of nucleotides) related by the base-pairing rules. For example, the sequence "C-A-G-T," is complementary to the sequence "G-T-C-A." Complementarity may be "partial" or "total." "Partial" complementarity is where one or more nucleic acid bases is not matched according to the base pairing rules. "Total" or "complete" complementarity between nucleic acids is where each and every nucleic acid base is matched with another base under the base pairing rules. The degree of complementarity between nucleic acid strands has significant effects on the efficiency and strength of hybridization between nucleic acid strands. This is of particular importance in amplification reactions, as well as detection methods which depend upon binding between nucleic acids.

The terms "homology" and "homologous" as used herein in reference to nucleotide sequences refer to a degree of complementarity with other nucleotide sequences. There may be partial homology or complete homology (i.e., identity). A nucleotide sequence which is partially complementary, i.e., "substantially homologous," to a nucleic acid sequence is one that at least partially inhibits a completely complementary sequence from hybridizing to a target nucleic acid sequence. The inhibition of hybridization of the completely complementary sequence to the target sequence may be examined using a hybridization assay (Southern or Northern blot, solution hybridization and the like) under conditions of low stringency. A substantially homologous sequence or probe will compete for and inhibit the binding (i.e., the hybridization) of a completely homologous sequence to a target sequence under conditions of low stringency. This is not to say that conditions of low stringency are such that non-specific binding is permitted; low stringency conditions require that the binding of two sequences to one another be a specific (i.e., selective) interaction. The absence of non-specific binding may be tested by the use of a second target sequence which lacks even a partial degree of complementarity (e.g., less than about 30% identity); in the absence of non-specific binding the probe will not hybridize to the second non-complementary target.

The terms "homology" and "homologous" as used herein in reference to amino acid sequences refer to the degree of identity of the primary structure between two amino acid sequences. Such a degree of identity may be directed a portion of each amino acid sequence, or to the entire length of the amino acid sequence. Two or more amino acid sequences that are "substantially homologous" may have at least 50% identity, preferably at least 75% identity, more preferably at least 85% identity, most preferably at least 95%, or 100% identity.

An oligonucleotide sequence which is a "homolog" is defined herein as an oligonucleotide sequence which exhibits greater than or equal to 50% identity to a sequence, when sequences having a length of 100 bp or larger are compared.

Low stringency conditions comprise conditions equivalent to binding or hybridization at 42° C. in a solution consisting of 5×SSPE (43.8 g/l NaCl, 6.9 g/l NaH$_2$PO$_4$·H$_2$0 and 1.85 g/l EDTA, pH adjusted to 7.4 with NaOH), 0.1% SDS, 5×Denhardt's reagent {50×Denhardt's contains per 500 ml: 5 g Ficoll (Type 400, Pharmacia), 5 g BSA (Fraction V; Sigma)} and 100 µg/ml denatured salmon sperm DNA followed by washing in a solution which may comprise 5×SSPE, 0.1% SDS at 42° C. when a probe of about 500 nucleotides in length, is employed. Numerous equivalent conditions may also be employed to comprise low stringency conditions; factors such as the length and nature (DNA, RNA, base composition) of the probe and nature of the target (DNA, RNA, base composition, present in solution or immobilized, etc.) and the concentration of the salts and other components (e.g., the presence or absence of formamide, dextran sulfate, polyethylene glycol), as well as components of the hybridization solution may be varied to generate conditions of low stringency hybridization different from, but equivalent to, the above listed conditions. In addition, conditions which promote hybridization under conditions of high stringency (e.g., increasing the temperature of the hybridization and/or wash steps, the use of formamide in the hybridization solution, etc.) may also be used.

As used herein, the term "hybridization" is used in reference to the pairing of complementary nucleic acids using any process by which a strand of nucleic acid joins with a complementary strand through base pairing to form a hybridization complex. Hybridization and the strength of hybridization (i.e., the strength of the association between the nucleic acids) is impacted by such factors as the degree of complementarity between the nucleic acids, stringency of the conditions involved, the Tm of the formed hybrid, and the G:C ratio within the nucleic acids.

As used herein the term "hybridization complex" refers to a complex formed between two nucleic acid sequences by virtue of the formation of hydrogen bonds between complementary G and C bases and between complementary A and T bases; these hydrogen bonds may be further stabilized by base stacking interactions. The two complementary nucleic acid sequences hydrogen bond in an antiparallel configuration. A hybridization complex may be formed in solution (e.g., C0 t or R0 t analysis) or between one nucleic acid sequence present in solution and another nucleic acid sequence immobilized to a solid support (e.g., a nylon membrane or a nitrocellulose filter as employed in Southern and Northern blotting, dot blotting or a glass slide as employed in in situ hybridization, including FISH (fluorescent in situ hybridization)).

As used herein, the term "Tm" is used in reference to the "melting temperature." The melting temperature is the temperature at which a population of double-stranded nucleic acid molecules becomes half dissociated into single strands. As indicated by standard references, a simple estimate of the Tm value may be calculated by the equation: $Tm=81.5+0.41$ (% G+C), when a nucleic acid is in aqueous solution at 1M NaCl. Anderson et al., "Quantitative Filter Hybridization" In: Nucleic Acid Hybridization (1985). More sophisticated computations take structural, as well as sequence characteristics, into account for the calculation of Tm.

As used herein the term "stringency" is used in reference to the conditions of temperature, ionic strength, and the presence of other compounds such as organic solvents, under which nucleic acid hybridizations are conducted. "Stringency" typically occurs in a range from about Tm to about 20° C. to 25° C. below Tm. A "stringent hybridization" may be used to identify or detect identical polynucleotide sequences or to identify or detect similar or related polynucleotide sequences. For example, when fragments of SEQ ID NO:2 are employed in hybridization reactions under stringent conditions the hybridization of fragments of SEQ ID NO:2 which contain unique sequences (i.e., regions which are either non-homologous to or which contain less than about 50% homology or complementarity with SEQ ID NOs:2) are favored. Alternatively, when conditions of "weak" or "low" stringency are used hybridization may occur with nucleic acids that are derived from organisms that are genetically diverse (i.e., for example, the frequency of complementary sequences is usually low between such organisms).

As used herein, the term "amplifiable nucleic acid" is used in reference to nucleic acids which may be amplified by any amplification method. It is contemplated that "amplifiable nucleic acid" will usually comprise "sample template."

As used herein, the term "sample template" refers to nucleic acid originating from a sample which is analyzed for the presence of a target sequence of interest. In contrast, "background template" is used in reference to nucleic acid other than sample template which may or may not be present in a sample. Background template is most often inadvertent. It may be the result of carryover, or it may be due to the presence of nucleic acid contaminants sought to be purified away from the sample. For example, nucleic acids from organisms other than those to be detected may be present as background in a test sample.

"Amplification" is defined as the production of additional copies of a nucleic acid sequence and is generally carried out using polymerase chain reaction. Dieffenbach C. W. and G. S. Dveksler (1995) In: PCR Primer, a Laboratory Manual, Cold Spring Harbor Press, Plainview, N.Y.

As used herein, the term "polymerase chain reaction" ("PCR") refers to the method of K. B. Mullis U.S. Pat. Nos. 4,683,195 and 4,683,202, herein incorporated by reference, which describe a method for increasing the concentration of a segment of a target sequence in a mixture of genomic DNA without cloning or purification. The length of the amplified segment of the desired target sequence is determined by the relative positions of two oligonucleotide primers with respect to each other, and therefore, this length is a controllable parameter. By virtue of the repeating aspect of the process, the method is referred to as the "polymerase chain reaction" (hereinafter "PCR"). Because the desired amplified segments of the target sequence become the predominant sequences (in terms of concentration) in the mixture, they are said to be "PCR amplified". With PCR, it is possible to amplify a single copy of a specific target sequence in genomic DNA to a level detectable by several different methodologies (e.g., hybridization with a labeled probe; incorporation of biotinylated primers followed by avidin-enzyme conjugate detection; incorporation of 32P-labeled deoxynucleotide triphosphates, such as dCTP or dATP, into the amplified segment). In addition to genomic DNA, any oligonucleotide sequence may be amplified with the appropriate set of primer molecules. In particular, the amplified segments created by the PCR process itself are, themselves, efficient templates for subsequent PCR amplifications.

As used herein, the term "primer" refers to an oligonucleotide, whether occurring naturally as in a purified restriction digest or produced synthetically, which is capable of acting as a point of initiation of synthesis when placed under conditions in which synthesis of a primer extension product which is complementary to a nucleic acid strand is induced, (i.e., in the presence of nucleotides and an inducing agent such as DNA polymerase and at a suitable temperature and pH). The primer is preferably single stranded for maximum efficiency in amplification, but may alternatively be double stranded. If double stranded, the primer is first treated to separate its strands before being used to prepare extension products. Preferably, the primer is an oligodeoxy-ribonucleotide. The primer must be sufficiently long to prime the synthesis of extension products in the presence of the inducing agent. The exact lengths of the primers will depend on many factors, including temperature, source of primer and the use of the method.

As used herein, the term "probe" refers to an oligonucleotide (i.e., a sequence of nucleotides), whether occurring naturally as in a purified restriction digest or produced synthetically, recombinantly or by PCR amplification, which is capable of hybridizing to another oligonucleotide of interest. A probe may be single-stranded or double-stranded. Probes are useful in the detection, identification and isolation of particular gene sequences. It is contemplated that any probe used in the present invention will be labeled with any "reporter molecule," so that it is detectable in any detection system, including, but not limited to enzyme (e.g., ELISA, as well as enzyme-based histochemical assays), fluorescent, radioactive, and luminescent systems. It is not intended that the present invention be limited to any particular detection system or label.

As used herein, the terms "restriction endonucleases" and "restriction enzymes" refer to bacterial enzymes, each of which cut double-stranded DNA at or near a specific nucleotide sequence.

DNA molecules are said to have "5' ends" and "3' ends" because mononucleotides are reacted to make oligonucleotides in a manner such that the 5' phosphate of one mononucleotide pentose ring is attached to the 3' oxygen of its neighbor in one direction via a phosphodiester linkage. Therefore, an end of an oligonucleotide is referred to as the "5' end" if its 5' phosphate is not linked to the 3' oxygen of a mononucleotide pentose ring. An end of an oligonucleotide is referred to as the "3' end" if its 3' oxygen is not linked to a 5' phosphate of another mononucleotide pentose ring. As used herein, a nucleic acid sequence, even if internal to a larger oligonucleotide, also may be said to have 5' and 3' ends. In either a linear or circular DNA molecule, discrete elements are referred to as being "upstream" or 5' of the "downstream" or 3' elements. This terminology reflects the fact that transcription proceeds in a 5' to 3' fashion along the DNA strand. The promoter and enhancer elements which direct transcription of a linked gene are generally located 5' or upstream of the coding region. However, enhancer elements may exert their effect even when located 3' of the promoter element and the coding region. Transcription termination and polyadenylation signals are located 3' or downstream of the coding region.

As used herein, the term "an oligonucleotide having a nucleotide sequence encoding a gene" means a nucleic acid sequence which may comprise the coding region of a gene, i.e. the nucleic acid sequence which encodes a gene product. The coding region may be present in a cDNA, genomic DNA or RNA form. When present in a DNA form, the oligonvoleotide may be single-stranded (i.e., the sense strand) or double-stranded. Suitable control elements such as enhancers/promoters, splice junctions, polyadenylation signals, etc. may be placed in close proximity to the coding region of the gene if needed to permit proper initiation of transcription and/or correct processing of the primary RNA transcript. Alternatively, the coding region utilized in the expression vectors of the present invention may contain endogenous enhancers/promoters, splice junctions, intervening sequences, polyadenylation signals, etc. or a combination of both endogenous and exogenous control elements.

The term "poly A site" or "poly A sequence" as used herein denotes a DNA sequence which directs both the termination and polyadenylation of the nascent RNA transcript. Efficient polyadenylation of the recombinant transcript is desirable as transcripts lacking a poly A tail are unstable and are rapidly degraded. The poly A signal utilized in an expression vector may be "heterologous" or "endogenous." An endogenous poly A signal is one that is found naturally at the 3' end of the coding region of a given gene in the genome. A heterologous poly A signal is one which is isolated from one gene and placed 3' of another gene. Efficient expression of recombinant DNA sequences in eukaryotic cells involves expression of signals directing the efficient termination and polyadenylation of the resulting transcript. Transcription termination signals are generally found downstream of the polyadenylation signal and are a few hundred nucleotides in length.

As used herein, the terms "nucleic acid molecule encoding", "DNA sequence encoding," and "DNA encoding" refer to the order or sequence of deoxyribonucleotides along a strand of deoxyribonucleic acid. The order of these deoxyribonucleotides determines the order of amino acids along the polypeptide (protein) chain. The DNA sequence thus codes for the amino acid sequence.

The term "Southern blot" refers to the analysis of DNA on agarose or acrylamide gels to fractionate the DNA according to size, followed by transfer and immobilization of the DNA from the gel to a solid support, such as nitrocellulose or a nylon membrane. The immobilized DNA is then probed with a labeled oligodeoxyribonucleotide probe or DNA probe to detect DNA species complementary to the probe used. The DNA may be cleaved with restriction enzymes prior to electrophoresis. Following electrophoresis, the DNA may be partially depurinated and denatured prior to or during transfer to the solid support. Southern blots are a standard tool of molecular biologists. J. Sambrook et al. (1989) In: Molecular Cloning: A Laboratory Manual, Cold Spring Harbor Press, NY, pp 9.31-9.58.

The term "Northern blot" as used herein refers to the analysis of RNA by electrophoresis of RNA on agarose gels to fractionate the RNA according to size followed by transfer of the RNA from the gel to a solid support, such as nitrocellulose or a nylon membrane. The immobilized RNA is then probed with a labeled oligodeoxyribonucleotide probe or DNA probe to detect RNA species complementary to the probe used. Northern blots are a standard tool of molecular biologists. J. Sambrook, J. et al. (1989) supra, pp 7.39-7.52.

The term "reverse Northern blot" as used herein refers to the analysis of DNA by electrophoresis of DNA on agarose gels to fractionate the DNA on the basis of size followed by transfer of the fractionated DNA from the gel to a solid support, such as nitrocellulose or a nylon membrane. The immobilized DNA is then probed with a labeled oligoribonucleotide probe or RNA probe to detect DNA species complementary to the ribo probe used.

As used herein the term "coding region" when used in reference to a structural gene refers to the nucleotide sequences which encode the amino acids found in the nascent polypeptide as a result of translation of a mRNA molecule. The coding region is bounded, in eukaryotes, on the 5' side by the nucleotide triplet "ATG" which encodes the initiator methionine and on the 3' side by one of the three triplets which specify stop codons (i.e., TAA, TAG, TGA).

As used herein, the term "structural gene" refers to a DNA sequence coding for RNA or a protein. In contrast, "regulatory genes" are structural genes which encode products which control the expression of other genes (e.g., transcription factors).

As used herein, the term "gene" means the deoxyribonucleotide sequences which may comprise the coding region of a structural gene and including sequences located adjacent to the coding region on both the 5' and 3' ends for a distance of about 1 kb on either end such that the gene corresponds to the length of the full-length mRNA. The sequences which are located 5' of the coding region and which are present on the mRNA are referred to as 5' non-translated sequences. The sequences which are located 3' or downstream of the coding region and which are present on the mRNA are referred to as 3' non-translated sequences. The term "gene" encompasses both cDNA and genomic forms of a gene. A genomic form or clone of a gene contains the coding region interrupted with non-coding sequences termed "introns" or "intervening regions" or "intervening sequences." Introns are segments of a gene which are transcribed into heterogeneous nuclear RNA (hnRNA); introns may contain regulatory elements such as enhancers. Introns are removed or "spliced out" from the nuclear or primary transcript; introns therefore are absent in the messenger RNA (mRNA) transcript. The mRNA functions during translation to specify the sequence or order of amino acids in a nascent polypeptide.

In addition to containing introns, genomic forms of a gene may also include sequences located on both the 5' and 3' end of the sequences which are present on the RNA transcript. These sequences are referred to as "flanking" sequences or regions (these flanking sequences are located 5' or 3' to the non-translated sequences present on the mRNA transcript). The 5' flanking region may contain regulatory sequences such as promoters and enhancers which control or influence the transcription of the gene. The 3' flanking region may contain sequences which direct the termination of transcription, posttranscriptional cleavage and polyadenylation.

The term "label" or "detectable label" is used herein, to refer to any composition detectable by spectroscopic, photochemical, biochemical, immunochemical, electrical, optical or chemical means. Such labels include biotin for staining with labeled streptavidin conjugate, magnetic beads (e.g., Dynabeads®), fluorescent dyes (e.g., fluorescein, texas red, rhodamine, green fluorescent protein, and the like), radiolabels (e.g., 3H, 125I, 35S, 14C, or 32P), enzymes (e.g., horse radish peroxidase, alkaline phosphatase and others commonly used in an ELISA), and calorimetric labels such as colloidal gold or colored glass or plastic (e.g., polystyrene, polypropylene, latex, etc.) beads. Patents teaching the use of such labels include, but are not limited to, U.S. Pat. Nos. 3,817,837; 3,850,752; 3,939,350; 3,996,345; 4,277, 437; 4,275,149; and 4,366,241 (all herein incorporated by reference). The labels contemplated in the present invention may be detected by many methods. For example, radiolabels may be detected using photographic film or scintillation counters, fluorescent markers may be detected using a photodetector to detect emitted light. Enzymatic labels are typically detected by providing the enzyme with a substrate and detecting, the reaction product produced by the action of the enzyme on the substrate, and calorimetric labels are detected by simply visualizing the colored label.

The present invention is related to the field of genomic informatics and gene-expression profiling. Gene-expression profiles provide complex molecular fingerprints regarding the relative state of a cell or tissue. Similarities in gene-expression profiles between organic states (i.e., for example, normal and diseased cells and/or tissues) provide molecular taxonomies, classification, and diagnostics. Similarities in gene-expression profiles resulting from various external perturbations (i.e., for example, ablation or enforced expression of specific genes, and/or small molecules, and/or environmental changes) reveal functional similarities between these perturbagens, of value in pathway and mechanism-of-action elucidation. Similarities in gene-expression profiles between organic (e.g. disease) and induced (e.g. by small molecule) states may identify clinically-effective therapies. Improvements described herein allow for the efficient and economical generation of full-transcriptome gene-expression profiles by identifying cluster centroid landmark transcripts that predict the expression levels of other transcripts within the same cluster.

Some embodiments of the present invention contemplate performing genome-wide transcriptional profiling for applications including, but not limited to, disease classification and diagnosis without resort to expensive and laborious microarray technology (i.e., for example, Affymetrix GeneChip microarrays). Other uses include, but are not limited to, generating gene-expression data for use in and with information databases (i.e., for example, connectivity maps). A connectivity map typically may comprise a collection of a large number of gene-expression profiles together with allied pattern-matching software. The collection of profiles is searched with the pattern-matching algorithm for profiles that are similar to gene-expression data derived from a biological state of interest. The utility of this searching and pattern-matching exercise resides in the belief that similar biological states may be identified through the transitory feature of common gene-expression changes. The gene-expression profiles in a connectivity map may be derived from known cellular states, or cells or tissues treated with known chemical or genetic perturbagens. In this mode, the connectivity map is a tool for the functional annotation of the biological state of interest. Alternatively, the connectivity map is populated with gene-expression profiles from cells or tissues treated with previously uncharacterized or novel perturbagens. In this mode, the connectivity map functions as a screening tool. Most often, a connectivity map is populated with profiles of both types. Connectivity maps, in general, establish biologically-relevant connections between disease states, gene-product function, and small-molecule action. In particular, connectivity maps have wide-ranging applications including, but not limited to, functional annotation of unknown genes and biological states, identification of the mode of action or functional class of a small molecule, and the identification of perturbagens that modulate or reverse a disease state towards therapeutic advantage as potential drugs. See Lamb et al, "The Connectivity Map: using gene-expression signatures to connect small molecules, genes and disease" *Science* 313: 1929-1935 (2006), and Lamb, "The Connectivity Map: a new tool for biomedical research" *Nature Reviews Cancer* 7: 54-60 (2007). However, the high cost of generating gene-expression profiles severely limits the size and scope of connectivity maps. A connectivity map populated with gene-expression profiles derived from every member of an industrial small-molecule drug-screening library, a saturated combinatorial or diversity-orientated chemical library, a comprehensive collection of crude or purified plant or animal extracts, or from the genetic ablation or forced expression of every gene in a mammalian genome, for example, would be expected to facilitate more, and more profound, biological discoveries than those of existing connectivity maps. Although it is not necessary to understand the mechanism of an invention, it is believed that the presently disclosed method for gene-expression profiling reduces the cost of generating these profiles by more than 30-fold. The present invention contemplates the creation of connectivity maps with at least 100,000 gene-expression profiles, and ultimately, many millions of gene-expression profiles.

The present invention contemplates compositions and methods for making and using a transcriptome-wide gene-expression profiling platform that measures the expression levels of only a select subset of the total number of transcripts. Because gene expression is believed to be highly correlated, direct measurement of a small number (for example, 1,000) of appropriately-selected "landmark" transcripts allows the expression levels of the remainder to be inferred. The present invention, therefore, has the potential to reduce the cost and increase the throughput of full-transcriptome gene-expression profiling relative to the well-known conventional approaches that require all transcripts to be measured.

In one embodiment, the present invention contemplates identifying landmark transcripts from a computational analysis of a large collection of transcriptome-wide gene-expression profiles. In one embodiment, the profiles contain identities and expression levels of a large proportion (preferably more than 70%) of the known transcripts in the genome. In one preferred embodiment, the profiles are generated by the use of high-density DNA microarrays commercially-available from, but not limited to, Affymetrix, Agilent, and Illumina. Suitable profiles may also be generated by other transcriptome-analysis methods including, but not limited to, Serial Analysis of Gene Expression (SAGE) and deep cDNA sequencing. In one preferred embodiment, all profiles are generated with the same analysis method. In one especially preferred embodiment, all profiles are generated using Affymetrix oligonucleotide microarrays. In one embodiment, the number of profiles in the collection exceeds 1,000, and preferably is more than 10,000. In one preferred embodiment, the profiles derive from a broad diversity of normal and diseased tissue and/or cell types. As known to those skilled in the art, collections of suitable gene-expression profiles are available from public and private, commercial sources. In one preferred embodiment, gene-expression profiles are obtained from NCBI's Gene Expression Omnibus (GEO). In one embodiment, expression levels in the profiles in the collection are scaled relative to each other. Those skilled in the art will be aware of a variety of methods to achieve such normalization, including, but not limited to, quantile normalization (preferably RMA). In one preferred embodiment, expression levels in the profiles in the collection are scaled relative to each other using a set of transcripts (numbering approximately 100, and preferably approximately 350) having the lowest coefficients-of-variation (CV) of all transcripts at each of a number (preferably approximately 14) of expression levels chosen to span the range of expression levels observed, from an independent collection of transcriptome-wide gene-expression profiles (numbering at least 1,000 and preferably approximately 7,000).

In one preferred embodiment, profiles used to identify landmark transcripts are required to exceed a minimum standard for data quality (i.e., for example, quality control (QC) analysis). The samples passing the QC analysis are identified as a core dataset. Suitable data-quality measures are known to those skilled in the art and include, but are not limited to, percentage-of-P-calls and 3'-to-5' ratios. In one embodiment, an empirical distribution of data-quality measures is built and outlier profiles eliminated from the collection. In one preferred embodiment, profiles with data-quality measures beyond the 95th percentile of the distribution are eliminated from the collection. In one preferred embodiment, the set of transcripts represented in all profiles in the collection is identified, and the remainder eliminated from all of the profiles. In one embodiment, the set of transcripts below the limit of detection in a large proportion of the profiles (preferably 99%) are eliminated from the profiles.

In one embodiment, the present invention contemplates using dimensionality reduction in combination with cluster analysis to select transcripts to be measured (i.e., for example, landmark transcripts). While dimensionality reduction may be performed by a number of known methods, the embodiments described herein utilize principal component analysis. In one embodiment, the method further may comprise using a linear dimension reduction method (i.e., for example, using eigenvectors). In one embodiment, the cluster analysis creates a plurality of clusters wherein each cluster may comprise a single cluster centroid landmark transcript and a plurality of cluster non-centroid transcripts. See FIG. 1. In one preferred embodiment, clusters are achieved by using k-means clustering, wherein the k-means clustering is repeated a number of times allowing a consensus matrix to be constructed (i.e., for example, a gene-by-gene pairwise consensus matrix).

In one preferred embodiment, pockets of high local correlation are identified by hierarchically clustering the gene-by-gene pairwise consensus matrix. As is known to those skilled in the art, the tree from the hierarchical clustering may then be cut at multiple levels. At each level, there are numerous nodes, wherein the leaves (i.e., for example, illustrated herein as transcripts) in each node represent a tight cluster. For each tight cluster, a representative centroid 'landmark' transcript may be chosen by picking the transcript whose individual profile most closely correlates with the tight-cluster's mean profile. In one preferred embodiment, the cluster analysis identifies multiple (preferably more than 3 and less than 10) centroid landmark transcripts. Although it is not necessary to understand the mechanism of an invention, it is believed that the expression level of cluster centroid landmark transcripts may be used to infer the expression level of the associated cluster non-centroid transcripts.

In one embodiment, the present invention contemplates a method which may comprise creating gene-expression profiles from data consisting only of cluster centroid landmark transcript expression-level measurements. In one embodiment, medically-relevant similarities between biological samples are identified by similarities in their corresponding gene-expression profiles produced in the space of cluster centroid landmark transcripts.

In one preferred embodiment, the levels of non-measured transcripts in a new biological sample are inferred (i.e., for example, predicted) from the measurements of the landmark transcripts with reference to a dependency matrix, thereby creating a full-transcriptome gene-expression profile. In one embodiment, a dependency matrix is constructed by performing linear regression between the expression levels of each of the cluster centroid landmark genes (g) and the expression levels of all of the non-landmark transcripts (G) in a collection of transcriptome-wide expression profiles. In one preferred embodiment, a pseudo-inverse is used to build the dependency matrix (G non-landmark transcripts×g landmark transcripts). In one preferred embodiment, the collection of transcriptome-wide expression profiles used to build the dependency matrix is the same collection used to identify the cluster centroid landmark transcripts. In another embodiment, the collection of transcriptome-wide expression profiles used to build the dependency matrix is different from that used to identify the cluster centroid landmark transcripts. In one preferred embodiment, multiple dependence matrices are constructed from collections of transcriptome-wide expression profiles, each collection populated with profiles derived from the same type of normal or diseased tissues or cells. In one embodiment, the choice of dependency matrix to use for the inference is made based upon knowledge of the tissue, cell and/or pathological state of the sample. In one preferred embodiment, the expression level of each non-landmark transcript in a new biological sample is inferred by multiplying the expression levels of each of the landmark transcripts by the corresponding weights looked up from the dependency matrix, and summing those products.

In one preferred embodiment, the present invention contemplates a method which may comprise the creation of full-transcriptome gene-expression profiles using measurements of a plurality of landmark transcripts and inference of non-landmark transcript levels, wherein those profiles have at least 80% of the performance of gene-expression profiles produced by direct measurement of all transcripts, in a useful application of gene-expression profiling.

In one embodiment, the present invention contemplates determining the number of cluster centroid landmark transcripts suitable for the creation of transcriptome-wide gene-expression profiles by experimentation. In one embodiment, the number of cluster centroid landmark transcripts suitable for the creation of transcriptome-wide gene-expression profiles is determined by simulation.

Figure 2:
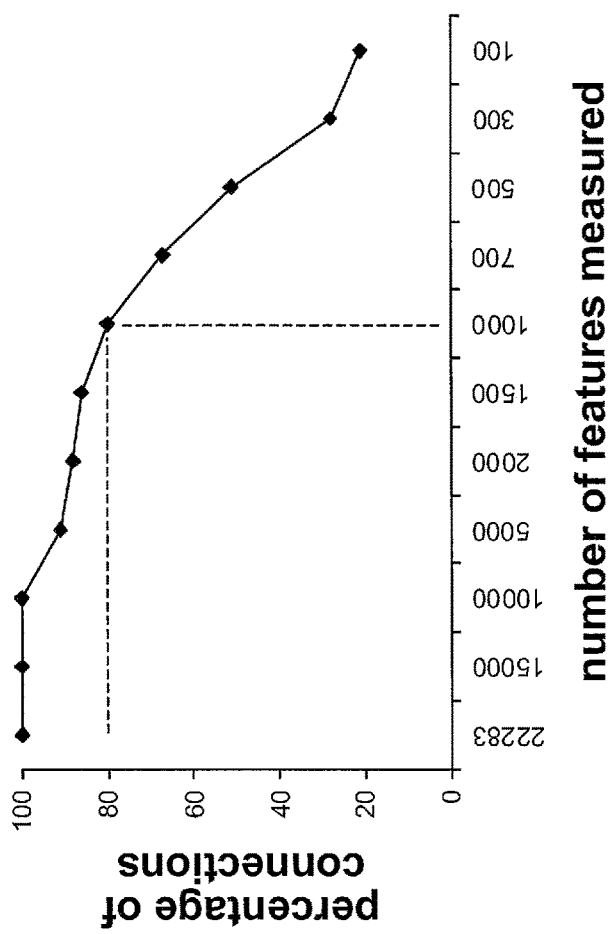
FIG. 2 presents exemplary results using Connectivity Map data demonstrating that approximately 80% of the connections observed between 184 query signatures and gene-expression profiles produced by measuring approximately 22,000 transcripts are recovered using gene-expression profiles created by measuring only approximately 1,000 transcripts and predicted the expression levels of the remainder.

A computational simulation presented herein (Examples I and II) demonstrates that dimensionality reduction may be applied to the identification of a plurality of cluster centroid landmark transcripts, and that surprisingly few landmark-transcript measurements are sufficient to faithfully recreate full-transcriptome profiles. It is shown that the expression levels of only 1,000 cluster centroid landmark transcripts (i.e., for example, <5% of transcripts in the transcriptome) may be used to recreate full-transcriptome expression profiles that perform as well as profiles in which all transcripts were measured directly in 80% of tests for profile similarity examined. Further, these data demonstrate that 500 centroid landmark transcripts (i.e., for example, <2.5% of transcripts in the transcriptome) recovers approximately 50% of such similarities (FIG. 2).

In one preferred embodiment, the present invention contemplates a method which may comprise approximately 1,000 cluster centroid landmark transcripts from which the expression levels of the remainder of the transcriptome may be inferred.

In one embodiment, the present invention contemplates measuring the expression levels of a set of cluster centroid landmark transcripts in a biological sample which may comprise a plurality of transcripts, and using a corresponding dependency matrix to predict the expression levels of the transcripts not measured, thereby creating a full-transcriptome expression profile. In one preferred embodiment, the expression levels of the set of cluster centroid landmark transcripts are measured simultaneously. In another preferred embodiment, the number of cluster centroid landmark transcripts measured is approximately 1,000. In another preferred embodiment, the expression levels of the set of cluster centroid landmark transcripts are measured using a moderate-multiplex assay platform. As is well known to those skilled in the art, there are many methods potentially capable of determining the expression level of a moderate number (i.e. approximately 10 to approximately 1,000) of transcripts simultaneously. These include, but are not limited to, multiplexed nuclease-protection assay, multiplexed RT-PCR, DNA microarrays, nucleic-acid sequencing, and various commercial solutions offered by companies including, but not limited to, Panomics, High Throughput Genomics, NanoString, Fluidigm, Nimblegen, Affymetrix, Agilent, and Illumina.

In one preferred embodiment, the present invention contemplates a method for generating a full-transcriptome gene-expression profile by simultaneously measuring the expression levels of a set of cluster centroid landmark transcripts in a biological sample which may comprise a plurality of transcripts, and using a corresponding dependency matrix to predict the expression levels of the transcripts not measured, where the said simultaneous measurements are made using nucleic-acid sequencing.

Figure 3:
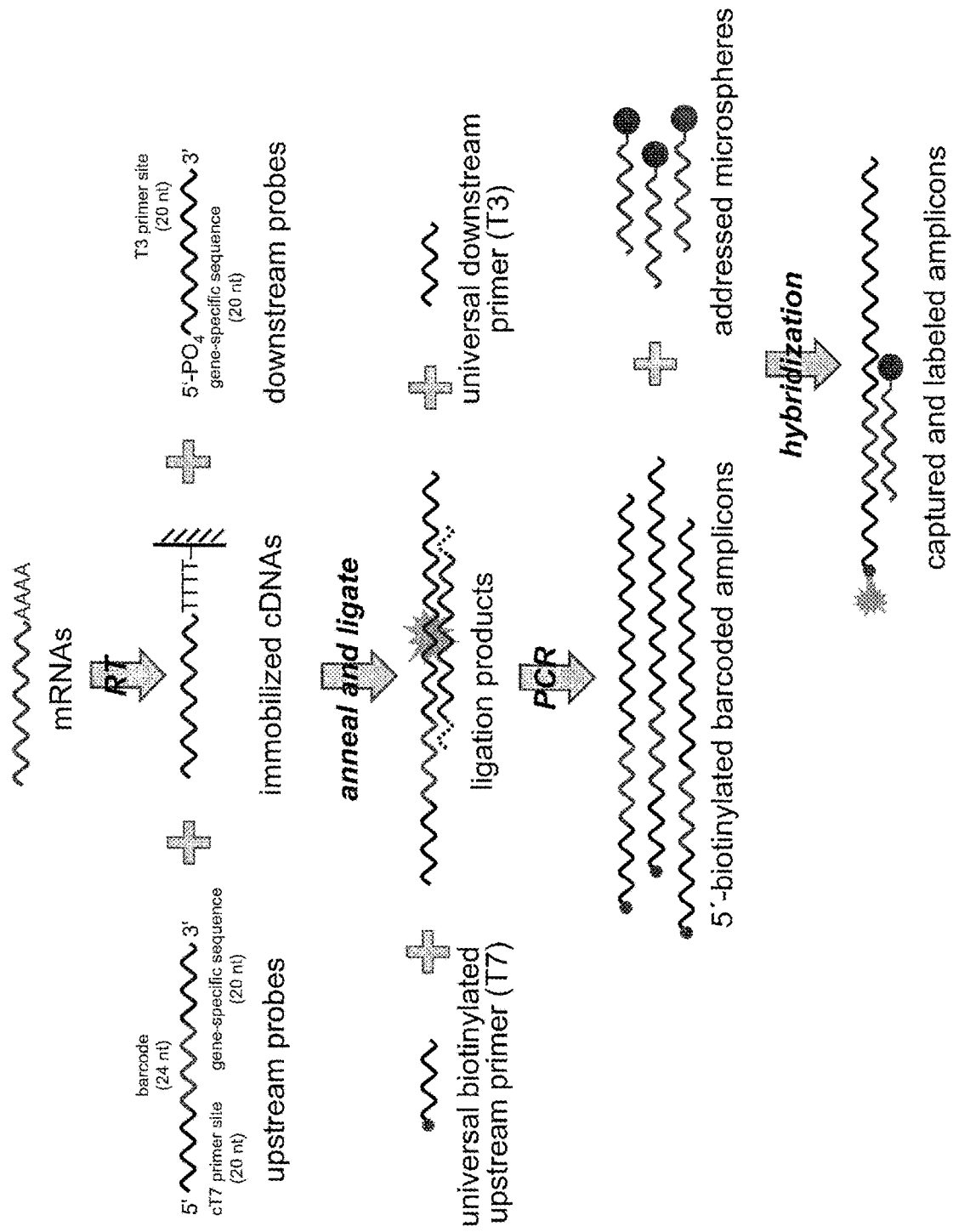
FIG. 3 presents one embodiment of a method for measuring the expression levels of multiple transcripts simultaneously using ligation-mediated amplification and optically-addressed microspheres.

In one preferred embodiment, the present invention contemplates a method for generating a full-transcriptome gene-expression profile by simultaneously measuring the expression levels of a set of cluster centroid landmark transcripts in a biological sample which may comprise a plurality of transcripts, and using a corresponding dependency matrix to predict the expression levels of the transcripts not measured, where the said simultaneous measurements are made using multiplex ligation-mediated amplification with Luminex FlexMAP optically-addressed and barcoded microspheres and flow-cytometric detection (LMF); Peck et al., "A method for high-throughput gene expression signature analysis" *Genome Biology* 7:R61 (2006). See FIG. 3. In this technique, transcripts are captured on immobilized poly-dT and reverse transcribed. Two oligonucleotide probes are designed for each transcript of interest. Upstream probes contain 20 nt complementary to a universal primer (T7) site, one of a set of unique 24 nt barcode sequences, and a 20 nt sequence complementary to the corresponding first-strand cDNA. Downstream probes are 5'-phosphorylated and contain 20 nt contiguous with the gene-specific fragment of the corresponding upstream probe and a 20 nt universal-primer (T3) site. Probes are annealed to target cDNAs, free probes removed, and juxtaposed probes joined by the action of ligase enzyme to yield 104 nt amplification templates. PCR is performed with T3 and 5'-biotinylated T7 primers. Biotinylated barcoded amplicons are hybridized against a pool of optically-addressed microspheres each expressing capture probes complementary to a barcode, and incubated with streptavidin-phycoerythrin to label biotin moieties fluorescently. Captured labeled amplicons are quantified and beads decoded by flow cytometry in Luminex detectors. The above reported LMF method was limited to measuring 100 transcripts simultaneously due to the availability of only 100 optical addresses. In one embodiment, the present invention contemplates a method for generating gene-expression profiles using simultaneous measurement of the levels of cluster centroid landmark transcripts that is compatible with an expanded number (approximately 500, and preferably 1,000) of barcode sequences, and optically-addressed microspheres and a corresponding flow-cytometric detection device. In one embodiment, the present invention contemplates a method which may comprise two assays per biological sample, each capable of measuring the expression levels of approximately 500 cluster centroid transcripts. In one embodiment, the present invention contemplates a method were the expression levels of approximately 1,000 cluster centroid landmark transcripts are measured in one assay per biological sample using less than 1,000 populations of optically-addressed microspheres by arranging for microspheres to express more than one type of capture probe complementary to a barcode. In one embodiment, the present invention contemplates a method which may comprise one assay per sample, each capable of measuring the expression levels of 1,000 cluster centroid landmark transcripts.

As is well known to those skilled in the art, an estimate of the expression level of a transcript made with one method (e.g. RT-PCR) does not always agree with the estimate of the expression level of that same transcript in the same biological sample made with another method (e.g. DNA microarray). In one embodiment, the present invention contemplates a method for selecting the set of cluster centroid landmark transcripts to be measured by a given moderate-multiplex assay platform for the purposes of predicting the expression levels of transcripts not measured, and thereby to create a full-transcriptome gene-expression profile, from the set of all possible cluster centroid landmark transcripts by experimentation. In one preferred embodiment, the set of cluster centroid landmark transcripts to be measured by a given moderate-multiple assay platform is selected by empirically confirming concordance between measurements of expression levels of cluster centroid landmark transcripts made by that platform and those made using the transcriptome-wide gene-expression profiling technology used to generate the collection of gene-expression profiles from which the universe of cluster centroid landmark transcripts was originally selected. In one especially preferred embodiment, the expression levels of all possible cluster centroid landmark transcripts (preferably numbering approximately 1,300) in a collection of biological samples (preferably numbering approximately 384) are estimated by both LMF and Affymetrix oligonucleotide microarrays, where Affymetrix oligonucleotide microarrays were used to produce the transcriptome-wide gene-expression profiles from which the universe of possible cluster centroid landmark transcripts was selected, resulting in the identification of a set of cluster centroid landmark transcripts (preferably numbering approximately 1,100) whose expression level estimated by LMF is consistently concordant with the expression levels estimated by Affymetrix oligonucleotide microarrays. Data presented herein (Example III) show unanticipated discordances between expression-level measurements made using LMF and Affymetrix oligonucleotide microarrays.

In one embodiment, the present invention contemplates a method for selecting the final set of cluster centroid landmark transcripts to be measured by a given moderate-multiplex assay platform for the purposes of predicting the expression levels of transcripts not measured, and thereby to create a full-transcriptome gene-expression profile, from the set of all possible cluster centroid landmark transcripts by experimentation. In one preferred embodiment, the set of cluster centroid landmark transcripts to be measured by a given moderate-multiple assay platform is selected by empirically confirming that measurements of their expression levels made by that platform may be used to predict the expression level of non-landmark transcripts in their cluster measured using the transcriptome-wide gene-expression profiling technology used to generate the collection of gene-expression profiles from which the universe of cluster centroid landmark transcripts was selected.

In one especially preferred embodiment, the expression levels of all possible cluster centroid landmark transcripts (preferably numbering approximately 1,300) in a collection of biological samples (preferably numbering approximately 384) are measured by LMF, and the expression levels of all non-landmark transcripts are measured in that same collection of biological samples by Affymetrix oligonucleotide microarrays, where Affymetrix oligonucleotide microarrays were used to produce the transcriptome-wide gene-expression profiles from which the universe of possible cluster centroid landmark transcripts was selected, resulting in the identification of a final set of cluster centroid landmark transcripts (preferably numbering approximately 1,000) whose expression levels estimated by LMF may consistently be used to predict the expression level of transcripts in their clusters as measured by Affymetrix oligonucleotide microarrays. Data presented herein (Example III) show unanticipated failures of measurements of the expression levels of certain cluster centroid landmark made using LMF to be useful for predicting the expression levels of transcripts in their cluster measured using Affymetrix oligonucleotide microarrays.

In one embodiment, the present invention contemplates creating a dependency matrix specific to the final set of cluster centroid landmark transcripts selected for a given moderate-multiplex assay platform.

Data presented herein (Examples IV, V, VI, VII) demonstrate the generation of useful transcriptome-wide gene-expression profiles from the measurement of the expression levels of a set of cluster centroid landmark transcripts selected for use with a specific moderate-multiplex assay platform.

In one embodiment, the present invention contemplates a method which may comprise normalization (i.e., for example, scaling) of gene-expression data to correct for day-to-day or detector-to-detector variability in signal intensities. Although it is not necessary to understand the mechanism of an invention, it is believed that in transcriptome-wide gene-expression profiles (i.e., for example, high-density microarray data with approximately 20,000 dimensions) convention assumes that the vast majority of the transcripts do not change in a given state. Such an assumption allows a summation of the expression levels for all transcripts to be taken as a measure of overall signal intensity. Those using conventional systems then normalize the expression level of each transcript against that overall signal-intensity value.

However, when using gene-expression profiles of lower dimensionality (i.e., for example, 1,000 transcripts) it is not reasonable to suppose that only a small fraction of those transcripts change, especially in the special case of cluster centroid landmark transcripts where the transcripts were selected, in part, because each exhibited different levels across a diversity of samples. Consequently, normalization relative to a sum of the levels of all transcripts is not suitable.

In one embodiment, the present invention contemplates normalizing gene-expression profiles relative to a set of transcripts whose levels do not change across a large collection of diverse sample (i.e., for example, invariant transcripts). Such a process is loosely analogous to the use of a so-called housekeeping gene (i.e., for example, GAPDH) as a reference in a qRT-PCR. Although it is not necessary to understand the mechanism of an invention, it is believed that the normalization described herein is superior to other known normalization techniques because the invariant transcripts are empirically determined to have invariant expression across a broad diversity of samples.

In one embodiment, the set of transcripts (numbering between 10 and 50, preferably 25) having the lowest coefficients-of-variation (CV) of all transcripts at each of a number (preferably approximately 14) of expression levels chosen to span the range of expression levels observed from a collection of transcriptome-wide gene-expression profiles (numbering at least 1,000 and preferably approximately 7,000), are identified as invariant transcripts. In one preferred embodiment, the collection of transcriptome-wide gene-expression profiles used to selected invariant transcripts is build02 of the Connectivity Map dataset (broadinstitute.org/cmap). In one preferred embodiment, a final set of invariant transcripts (numbering between 14 and 98, preferably 80) to be used to normalize measurements of expression levels of cluster centroid landmark transcripts made using a given moderate-multiplex assay platform is selected from the set of all invariant transcripts by empirically confirming concordance between measurements of their expression levels made by that platform and those made using the transcriptome-wide gene-expression profiling technology used to generate the collection of gene-expression profiles from which the invariant transcripts were originally identified, and that their expression levels are indeed substantially invariant, in a collection of biological samples (numbering preferably approximately 384).

Data presented herein (Examples IV, V, VI, VII) demonstrate the generation of useful transcriptome-wide gene-expression profiles from the measurement of the expression levels of a set of cluster centroid landmark transcripts measured on a selected moderate-multiple assay platform scaled relative to the expression levels of a set of invariant transcripts measured together on the same platform.

It has been reported that gene regulation may be studied on a genomic level using dimensionality reduction in combination with clustering techniques. For example, gene co-regulation may be inferred from gene co-expression dynamics (i.e., for example, gene-gene interactions) using a dimensionally reduced biological dataset. Capobianco E., "Model Validation For Gene Selection And Regulation Maps" *Funct Integr Genomics* 8(2):87-99 (2008). This approach suggests three feature extraction methods that may detect genes with the greatest differential expression by clustering analysis (i.e., for example, k-means) in combination with principal and/or independent component analysis. In transcriptomics, for instance, clusters may be formed by genes having similar expression patterns. Dimensionality reduction, however, is used primarily to eliminate "noise" from useful biological information. A correlation matrix may be computed whose decomposition applies according to an eigensystem including eigenvalues (i.e., for example, the energies of the modes) and eigenvectors (i.e., for example, γ, determined by maximizing the energy in each mode). Selecting representative differentially expressed genes may be performed by 'regularization via shrinkage' that isolates cluster outliers to pick the genes having the greatest differential levels of expression.

Other dimensionality reduction methods have been used in proteomic biomarker studies. For example, mass-spectra based proteomic profiles have been used as disease biomarkers that generate datasets having extremely high dimensionality (i.e. number of features or variables) of proteomic data with a small sample size. Among these methods, one report suggests using a feature selection method described as centroid shrinkage, wherein data sets may be evaluated using causal inference techniques. Training samples are used to identify class centroids, wherein a test sample is assigned to a class belonging to the closest centroid. Hilario et al., "Approaches To Dimensionality Reduction In Proteomic Biomarker Studies" *Brief Bioinform* 9(2):102-118 (2008). Centroid shrinkage analysis has been previously used in gene expression analysis to diagnose cancers.

One dimensionality reduction report identifies a subset of features from within a large set of features. Such a selection process is performed by training a support vector machine to rank the features according to classifier weights. For example, a selection may be made for the smallest number of genes that are capable of accurately distinguishing between medical conditions (i.e., for example, cancer versus non-cancer). Principal component analysis is capable of clustering gene expression data, wherein specific genes are selected within each cluster as highly correlated with the expression of cancer. Golub's eigenspace vector method to predict gene function with cancer is directly compared and contrasted as an inferior method. Barnhill et al., "Feature Selection Method Using Support Vector Machine Classifier" U.S. Pat. No. 7,542,959 (col 35-49).

Linear transformations (i.e., for example, principal component analysis) may also be capable of identifying low-dimensional embeddings of multivariate data, in a way that optimally preserves the structure of the data. In particular, the performance of dimensionality reduction may be enhanced. Furthermore, the resulting dimensionality reduction may maintain data coordinates and pairwise relationships between the data elements. Subsequent clustering of decomposition information may be integrated in the linear transformation that clearly show separation between the clusters, as well as their internal structure. Koren et al., "Robust Linear Dimensionality Reduction" *IEEE Trans Vis Comput Graph.* 10(4):459-470 (2004).

Further, the invention encompasses methods and systems for organizing complex and disparate data. Principal component analysis may be used to evaluate phenotypic, gene expression, and metabolite data collected from Arabidopsis plants treated with eighteen different herbicides. Gene expression and transcription analysis was limited to evaluating gene expression in the context of cell function. Winfield et al., "Methods And Systems For Analyzing Complex Biological Systems" U.S. Pat. No. 6,873,914.

Functional genomics and proteomics may be studied involving the simultaneous analysis of hundreds or thousands of expressed genes or proteins. From these large datasets, dimensionality reduction strategies have been used to identify clinically exploitable biomarkers from enormous experimental datasets. The field of transcriptomics could benefit from using dimensionality reduction methods in high-throughput methods using microarrays. Finn W G., "Diagnostic Pathology And Laboratory Medicine In The Age Of "omics" *J Mol Diagn.* 9(4):431-436 (2007).

Multifactor dimensionality reduction (MDR) may also be useful for detecting and modeling epistasis, including the identification of single nucleotide polymorphisms (SNPs). MDR pools genotypes into 'high-risk' and 'low-risk' or 'response' and 'non-response' groups in order to reduce multidimensional data into only one dimension. MDR has detected gene-gene interactions in diseases such as sporadic breast cancer, multiple sclerosis and essential hypertension. MDR may be useful in evaluating most common diseases that are caused by the non-linear interaction of numerous genetic and environmental variables. Motsinger et al., "Multifactor Dimensionality Reduction: An Analysis Strategy For Modeling And Detecting Gene-Gene Interactions In Human Genetics And Pharmacogenomics Studies" *Hum Genomics* 2(5):318-328 (2006).

Another report attempted to use 6,100 transcripts to represent the entire transcriptome in an effort to avoid measuring for genes that were not expected to be expressed. Hoshida et al, "Gene Expression in Fixed Tissues and Outcome in Hepatocellular Carcinoma" *New Engl J Med* 259:19 (2008).

mRNA expression may be measured by any suitable method, including but not limited to, those disclosed below.

In some embodiments, RNA is detected by Northern blot analysis. Northern blot analysis involves the separation of RNA and hybridization of a complementary labeled probe.

In other embodiments, RNA expression is detected by enzymatic cleavage of specific structures (INVADER assay, Third Wave Technologies; See e.g., U.S. Pat. Nos. 5,846,717, 6,090,543; 6,001,567; 5,985,557; and 5,994,069; each of which is herein incorporated by reference). The INVADER assay detects specific nucleic acid (e.g., RNA) sequences by using structure-specific enzymes to cleave a complex formed by the hybridization of overlapping oligonucleotide probes.

In still further embodiments, RNA (or corresponding cDNA) is detected by hybridization to an oligonucleotide probe. A variety of hybridization assays using a variety of technologies for hybridization and detection are available. For example, in some embodiments, TaqMan assay (PE Biosystems, Foster City, Calif.; See e.g., U.S. Pat. Nos. 5,962,233 and 5,538,848, each of which is herein incorporated by reference) is utilized. The assay is performed during a PCR reaction. The TaqMan assay exploits the 5'-3' exonuclease activity of the AMPLITAQ GOLD DNA polymerase. A probe consisting of an oligonucleotide with a 5'-reporter dye (e.g., a fluorescent dye) and a 3'-quencher dye is included in the PCR reaction. During PCR, if the probe is bound to its target, the 5'-3' nucleolytic activity of the AMPLITAQ GOLD polymerase cleaves the probe between the reporter and the quencher dye. The separation of the reporter dye from the quencher dye results in an increase of fluorescence. The signal accumulates with each cycle of PCR and may be monitored with a fluorimeter.

In yet other embodiments, reverse-transcriptase PCR (RT-PCR) is used to detect the expression of RNA. In RT-PCR, RNA is enzymatically converted to complementary DNA or "cDNA" using a reverse transcriptase enzyme. The cDNA is then used as a template for a PCR reaction. PCR products may be detected by any suitable method, including but not limited to, gel electrophoresis and staining with a DNA specific stain or hybridization to a labeled probe. In some embodiments, the quantitative reverse transcriptase PCR with standardized mixtures of competitive templates method described in U.S. Pat. Nos. 5,639,606, 5,643,765, and 5,876,978 (each of which is herein incorporated by reference) is utilized.

The method most commonly used as the basis for nucleic acid sequencing, or for identifying a target base, is the enzymatic chain-termination method of Sanger. Traditionally, such methods relied on gel electrophoresis to resolve, according to their size, wherein nucleic acid fragments are produced from a larger nucleic acid segment. However, in recent years various sequencing technologies have evolved which rely on a range of different detection strategies, such as mass spectrometry and array technologies.

One class of sequencing methods assuming importance in the art are those which rely upon the detection of PPi release as the detection strategy. It has been found that such methods lend themselves admirably to large scale genomic projects or clinical sequencing or screening, where relatively cost-effective units with high throughput are needed.

Methods of sequencing based on the concept of detecting inorganic pyrophosphate (PPi) which is released during a polymerase reaction have been described in the literature for example (WO 93/23564, WO 89/09283, WO 98/13523 and WO 98/28440). As each nucleotide is added to a growing nucleic acid strand during a polymerase reaction, a pyrophosphate molecule is released. It has been found that pyrophosphate released under these conditions may readily be detected, for example enzymatically e.g. by the generation of light in the luciferase-luciferin reaction. Such methods enable a base to be identified in a target position and DNA to be sequenced simply and rapidly whilst avoiding the need for electrophoresis and the use of labels.

At its most basic, a PPi-based sequencing reaction involves simply carrying out a primer-directed polymerase extension reaction, and detecting whether or not that nucleotide has been incorporated by detecting whether or not PPi has been released. Conveniently, this detection of PPi-release may be achieved enzymatically, and most conveniently by means of a luciferase-based light detection reaction termed ELIDA (see further below).

It has been found that dATP added as a nucleotide for incorporation, interferes with the luciferase reaction used for PPi detection. Accordingly, a major improvement to the basic PPi-based sequencing method has been to use, in place of dATP, a dATP analogue (specifically dATP.alpha.s) which is incapable of acting as a substrate for luciferase, but which is nonetheless capable of being incorporated into a nucleotide chain by a polymerase enzyme (WO 98/13523).

Further improvements to the basic PPi-based sequencing technique include the use of a nucleotide degrading enzyme such as apyrase during the polymerase step, so that unincorporated nucleotides are degraded, as described in WO 98/28440, and the use of a single-stranded nucleic acid binding protein in the reaction mixture after annealing of the primers to the template, which has been found to have a beneficial effect in reducing the number of false signals, as described in WO00/43540.

In other embodiments, gene expression may be detected by measuring the expression of a protein or polypeptide. Protein expression may be detected by any suitable method. In some embodiments, proteins are detected by immunohistochemistry. In other embodiments, proteins are detected by their binding to an antibody raised against the protein. The generation of antibodies is described below.

Antibody binding may be detected by many different techniques including, but not limited to (e.g., radioimmunoassay, ELISA (enzyme-linked immunosorbant assay), "sandwich" immunoassays, immunoradiometric assays, gel diffusion precipitation reactions, immunodiffusion assays, in situ immunoassays (e.g., using colloidal gold, enzyme or radioisotope labels, for example), Western blots, precipitation reactions, agglutination assays (e.g., gel agglutination assays, hemagglutination assays, etc.), complement fixation assays, immunofluorescence assays, protein A assays, and immunoelectrophoresis assays, etc.

In one embodiment, antibody binding is detected by detecting a label on the primary antibody. In another embodiment, the primary antibody is detected by detecting binding of a secondary antibody or reagent to the primary antibody. In a further embodiment, the secondary antibody is labeled.

In some embodiments, an automated detection assay is utilized. Methods for the automation of immunoassays include those described in U.S. Pat. Nos. 5,885,530, 4,981,785, 6,159,750, and 5,358,691, each of which is herein incorporated by reference. In some embodiments, the analysis and presentation of results is also automated. For example, in some embodiments, software that generates a prognosis based on the presence or absence of a series of proteins corresponding to cancer markers is utilized.

In other embodiments, the immunoassay described in U.S. Pat. Nos. 5,599,677 and 5,672,480; each of which is herein incorporated by reference.

In some embodiments, a computer-based analysis program is used to translate the raw data generated by the detection assay (e.g., the presence, absence, or amount of a given transcript or transcripts) into data of predictive value for a clinician or researcher. The clinician or researcher may access the predictive data using any suitable means. Thus, in some preferred embodiments, the present invention provides the further benefit that the clinician or researcher, who is not likely to be trained in genetics or genomics, need not understand the raw data. The data is presented directly to the clinician or researcher in its most useful form. The clinician or researcher is then able to immediately utilize the information in order to optimize the care of the subject or advance the discovery objectives.

The present invention contemplates any method capable of receiving, processing, and transmitting the information to and from laboratories conducting the assays, wherein the information is provided to medical personnel and/or subjects and/or researchers. For example, in some embodiments of the present invention, a sample (e.g., a biopsy or a serum or urine sample or perturbed cells or tissue) is obtained from a subject or experimental procedure and submitted to a profiling service (e.g., clinical laboratory at a medical facility, genomic profiling business, etc.), located in any part of the world (e.g., in a country different than the country where the subject resides, the experiment performed, or where the information is ultimately used) to generate raw data. Where the sample may comprise a tissue or other biological sample, the subject may visit a medical center to have the sample obtained and sent to the profiling center, or subjects may collect the sample themselves (e.g., a urine sample) and directly send it to a profiling center. Where the sample may comprise previously determined biological information, the information may be directly sent to the profiling service by the subject (e.g., an information card containing the information may be scanned by a computer and the data transmitted to a computer of the profiling center using an electronic communication system). Once received by the profiling service, the sample is processed and a profile is produced (i.e., expression data) specific for the diagnostic or prognostic information desired for the subject, or the discovery objective of the researcher.

The profile data is then prepared in a format suitable for interpretation by a treating clinician or researcher. For example, rather than providing raw expression data, the prepared format may represent a diagnosis or risk assessment for the subject, along with recommendations for particular treatment options, or mechanism-of-action, protein-target prediction, or potential therapeutic use for an experimental perturbagen. The data may be displayed to the clinician or researcher by any suitable method. For example, in some embodiments, the profiling service generates a report that may be printed for the clinician or researcher (e.g., at the point of care or laboratory) or displayed to the clinician or researcher on a computer monitor.

In some embodiments, the information is first analyzed at the point of care or laboratory or at a regional facility. The raw data is then sent to a central processing facility for further analysis and/or to convert the raw data to information useful for a clinician, patient or researcher. The central processing facility provides the advantage of privacy (all data is stored in a central facility with uniform security protocols), speed, and uniformity of data analysis. The central processing facility may then control the fate of the data following treatment of the subject or completion of the experiment. For example, using an electronic communication system, the central facility may provide data to the clinician, the subject, or researchers.

In some embodiments, the subject is able to directly access the data using the electronic communication system. The subject may chose further intervention or counseling based on the results. In some embodiments, the data is used for research use. For example, the data may be used to further optimize the inclusion or elimination of markers as useful indicators of a particular condition or stage of disease.

One method for differentiating between cell types within a heterogeneous cell mixture has been reported that generates a multimodal distribution pattern following simultaneous flow cytometric data collection. Specifically, multimodal/multispectral images of a population of cells were simultaneously collected, wherein photometric and/or morphometric features identifiable in the images were used to separate the population of cells into subpopulations. A multi-spectral flow cytometer was configured to detect light signals generated by a variety of labels such as, DAPI, FITC, dark field, PE, bright field, and Deep Red. These respective labels were conjugated to specific antibodies that had differential specific binding for normal cells versus diseased cells. Consequently, an abnormal ratio of detected cell patterns provides a basis for disease diagnosis. As such this method was limited to the ability to detect and label antigenic sites on biological cell surfaces that identified the cell's physiological state. Ortyn et al., "Blood And Cell Analysis Using An Imaging Flow Cytometer" United States Patent Application 2009/0190822 (herein incorporated by reference).

A qualitative and quantitative assessment of a plurality of analytes from a biological sample using microwell technology has been developed wherein the biological analytes are attached to a lithographic grid via known biological recognition elements. Identification of the analytes is accomplished by attaching luminescent labels having different emission wavelengths to either the analyte or the recognition element. Consequently, the assay may differentiate between analytes by using two or more labels having the same excitation wavelength, but differing in emission wavelength. Once the analytes are contacted with the lithographic grid, the analyte/recognition element complexes are detected using optically generated luminescent detection technology. Cross-reactivity between analytes could be differentiated by providing recognition elements having differing affinities for the respective analytes. Pawlak et al., "Kit and method for determining a plurality of analytes" U.S. Pat. No. 7,396,675 (herein incorporated by reference).

A method specific for detecting circulating antibodies has been reported that uses microspheres conjugated to labeled antigens for the antibodies. The labeled antigens are usually other antibodies having specific affinity for species-specific Fc portions of a circulating antibody. The labels are described as generally fluorescent labels that are detected using a conventional flow cytometer. A multiplex calibration technique is described that uses several subsets of microspheres or beads, wherein the surface of each microsphere subset has a different concentration of the same antigen. This calibration procedure thereby generates "a standard curve" such that the concentration of a circulating antibody may be estimated. Connelly et al., "Method and composition for homogeneous multiplexed microparticle-based assay" U.S. Pat. No. 7,674,632 (herein incorporated by reference).

Solution-based methods are generally based upon the use of detectable target-specific bead sets which comprise a capture probe coupled to a detectable bead, where the capture probe binds to an individual labeled target nucleic acid. Each population of bead sets is a collection of individual bead sets, each of which has a unique detectable label which allows it to be distinguished from the other bead sets within the population of bead sets (i.e., for example, ranging from 5-500 bead sets depending upon assay sensitivity parameters). Any labels or signals may be used to detect the bead sets as long as they provide unique detectable signals for each bead set within the population of bead sets to be processed in a single reaction. Detectable labels include but are not limited to fluorescent labels and enzymatic labels, as well as magnetic or paramagnetic particles (see, e.g., Dynabeads8 (Dynal, Oslo, Norway)). The detectable label may be on the surface of the bead or within the interior of the bead.

The composition of the beads may vary. Suitable materials include, but are not limited to, any materials used as affinity matrices or supports for chemical and biological molecule syntheses and analyses, including but not limited to: polystyrene, polycarbonate, polypropylene, nylon, glass, dextran, chitin, sand, pumice, agarose, polysaccharides, dendrimers, buckyballs, polyacrylamide, silicon, rubber, and other materials used as supports for solid phase syntheses, affinity separations and purifications, hybridization reactions, immunoassays and other such applications. Typically the beads have at least one dimension in the 5-10 mm range or smaller. The beads may have any shape and dimensions, but typically have at least one dimension that is 100 mm or less, for example, 50 mm or less, 10 mm or less, 1 mm or less, 100 pm or less, 50 pm or less, and typically have a size that is 10 pm or less such as, 1 pm or less, 100 nm or less, and 10 nm or less. In one embodiment, the beads have at least one dimension between 2-20 pm. Such beads are often, but not necessarily, spherical e.g. elliptical. Such reference, however, does not constrain the geometry of the matrix, which may be any shape, including random shapes, needles, fibers, and elongated. Roughly spherical, particularly microspheres that may be used in the liquid phase, also are contemplated. The beads may include additional components, as long as the additional components do not interfere with the methods and analyses herein.

Commercially available beads which may be used in the methods of the present invention include, but are not limited to, bead-based technologies available from Luminex, Illumina, and/or Lynx. In one embodiment, microbeads may be labeled with different spectral properties and/or fluorescent (or colorimetric) intensities. For example, polystyrene microspheres are provided by Luminex Corp, Austin, Tex. that are internally dyed with two spectrally distinct fluorochromes. Using precise ratios of these fluorochromes, a large number of different fluorescent bead sets may be produced (i.e., for example, 5-100 bead sets). Each set of the beads may be distinguished by its spectral address, a combination of which allows for measurement of a large number of analytes in a single reaction vessel. Alternatively, a detectable target molecule may be labeled with a third fluorochrome. Because each of the different bead sets is uniquely labeled with a distinguishable spectral address, the resulting hybridized bead-target complexes will be distinguishable for each different target nucleic acid, which may be detected by passing the hybridized bead-target complexes through a rapidly flowing fluid stream. In the stream, the beads are interrogated individually as they pass two separate lasers. High speed digital signal processing classifies each of the beads based on its spectral address and quantifies the reaction on the surface. Thousands of beads may be interrogated per second, resulting a high speed, high throughput and accurate detection of multiple different target nucleic acids in a single reaction. In addition to a detectable label, the bead sets may also contain a capture probe which may bind to an individual target analyte. For example, a capture probe may comprise a nucleic acid, a protein, a peptide, a biological receptor, an enzyme, a hormone, an antibody, a polyclonal antibody, a monoclonal antibody, and/or an Fab fragment. If the capture probe is a short unique DNA sequence, it may comprise uniform hybridization characteristics with a target nucleic acid analyte. The capture probe may be coupled to the beads using any suitable method which generates a stable linkage between probe and the bead, and permits handling of the bead without compromising the linkage using further methods of the invention. Nucleic acid coupling reactions include, but are not limited to, the use of capture probes modified with a 5' amine for coupling to carboxylated microsphere or bead.

Most bead-based analyte detection systems are based upon Luminex colored beads, and/or the Luminex flow cytometric measurement system. The flow cytometric measurement system provides a summary report of median fluorescent intensity (MFI) values for each measured analyte as well as bead-level output data for each sample. The bead-level output data is usually stored in a standard flow cytometry data format, includes a set membership and fluorescent intensity of each individual bead that is detected. Although it is not necessary to understand the mechanism of an invention, it is believed that data collection and storage capability suggests that the capacity of the commercially available Luminex system may be expanded beyond its commonly accepted limitations of 500 bead-sets per well.

The Luminex xMAP® technology is a commercially available bead-based system that has a limitation for simultaneous measurements of up to 500 analytes per sample. Measurement instruments used to support Luminex technology are basically flow cytometers capable of detecting and/or identifying 500 color bead set variations. Usually, each specific color bead variation provides a unique identification for an individual analyte. In particular, the system assigns each bead detected in a sample to a set based on its color. The system then summarizes the measurement value for each set by reporting the median fluorescent intensity (MFI) of all beads belonging to that set.

Recent advances in biotechnology, and in particular genomics, have exceeded the usefulness of data sets restricted to a 500 analyte assay. For example, in gene expression profiling, one might be interested in measuring the expression of more than 500 genes. One approach to overcome this limitation is to use two or more collections of the 500 bead sets, wherein each collection interrogates a different set of 500 genes. This approach requires measurement of the same sample in two separate wells to provide a complete assay. The problem with this approach is that it requires twice the amount of sample and takes twice the amount of time for detection. Duplicate sampling techniques is also prone to failures since failure of a single well also renders the data obtained from the duplicate sample well unusable. In addition, batch artifacts arise during the process of combining the wells that constitute a single sample.

The Luminex detector is analogous to a flow cytometer in that the instrument measures the fluorescent intensity of beads upon passage through a flow chamber. Alternatively, the detector may be a charged coupled device. Generally, at least two fluorescence measurements are recorded from a maximum of 500 differentially colored bead sets. As a single analyte is usually attached to each differentially colored bead, the fluorescent counts may be used to uniquely identify individual analytes. In particular, the system assigns each bead detected in a sample to a set based on its color. A complete Luminex bead-set which may comprise these 500 differentially colored beads may be depicted using a three dimensional coordinate plot. It is generally believed that the number of differentially colored beads that may be accurately classified to a bead-color-region is limited by the overlapping spectral regimes of the different colors used. For example, a bead-color-region may include, but not be limited to 500 beads each identified by a unique 3d coordinate using three classification laser measurements (CL1, CL2 and CL3) In addition to classifying the beads, the instrument records another fluorescence measurement known as a "reporter" for each bead. The "reporter" measurement is used to quantify the chemical reaction of interest and/or determine the presence or absence of an analyte (i.e., for example, mRNA).

Microfluidic devices have also been suggested to be used with methods where labeled microspheres (Luminex beads) would simultaneously detect multiple analytes in one of several sample chambers. These devices are constructed by a process known as multilayer soft lithography (MSL) that create multilayer microfluidic systems by binding multiple patterned layers of elastomers. For example, the presence of the multi-layered microchannels allows delivery of a different labeled microparticle to a specific sample chamber where a different analyte is detected. Each microparticle is specifically functionalized to bind a particular analyte. Therefore, each microparticle in a given sample chamber is capable of analyzing an analyte different from the analyte for each other microparticle in the same sample chamber. As the delivery of each microsphere is independently controlled, labeled microspheres may be added to their respective samples chambers in different proportions, presumably to optimize the detection of each specific analyte (i.e., for example, to prevent and/or overcome sample signal saturation). Diercks et al., "Multiplexed, microfluidic molecular assay device and assay method" United States Patent Application 2007/0183934 (herein incorporated by reference).

Microspheres, such as Luminex beads, has been described as a platform to support the amplification of nucleic acids and production of proteins, in addition to the phototransfer from one substrate to another substrate. In particular, the microspheres may be spectrally encoded through incorporation of semiconductor nanocrystals (or SCNCs). A desired fluorescence characteristic may be obtained by mixing SCNCs of different sizes and/or compositions in a fixed amount and ratio to create a solution having a specific fluorescence spectra. Therefore, a number of SCNC solutions may be prepared, each having a distinct distribution of semiconductor nanocrystal labeled microsphere size and composition, wherein each solution has a different fluorescence characteristic. Further, these solutions may be mixed in fixed proportions to arrive at a spectrum having predetermined ratios and intensities of emission from the distinct SCNCs suspended in that solution. Lim et al., "Methods for capturing nascent proteins" United States Patent Application 2010/0075374 (herein incorporated by reference).

Luminex bead systems have been described to improve the detection precision of a single analyte. A set of differently numbered microparticles (i.e., for example, belonging to different bead-sets or differential colors) are all coated with the same reagent so as to make them identical in sensitivity to the analyte being assayed. For example, an intra-assay titration curve may be constructed by coating the same fluorophore with different concentrations of labeled antibody, such that the same concentration of analyte is measured by detecting different signal magnitudes. Hanley B., "Intraplexing method for improving precision of suspended microarray assays" U.S. Pat. No. 7,501,290 (herein incorporated by reference).

The use of color coded beads has been described which may comprise nucleic acid capture moieties capable of 'tandem hybridization' with target nucleotides. Generally, a short capture probe is present on a color coded bead that binds a unique sequence of the target nucleic acid, while a longer labeled stacking probe has been preannealed to the target nucleic acid to facilitate subsequent detection. Each color coded bead therefore uniquely distinguishes between specific target nucleotides based upon the capture moiety nucleic acid sequence. Beattie et al., "Nucleic acid analysis using sequence-targeted tandem hybridization" U.S. Pat. No. 6,268,147 (herein incorporated by reference).

A solution-based method for determining the expression level of a population of labeled target nucleic acids has been developed that is based upon capturing the labeled target nucleic acids with color coded beads. Each bead is conjugated to a specific capture probe that binds to an individual labeled target nucleic acid. Usually, the capture probes are nucleic acids capable of hybridization to the labeled target nucleic acids such that their respective expression level may be determined within a biological sample. The method describes specific populations of target-specific bead sets, wherein each target-specific bead set is individually detectable and hybridizes to only one target nucleic acid. Specifically, the target-specific bead sets are described as having at least 5 individual bead sets that may bind with a corresponding set of target nucleic acids. As such, the bead population of a target-specific bead set may contain at least 100 individual beads that bind with a corresponding set of target nucleic acid. Golub et al., "Solution-based methods for RNA expression profiling" United States Patent Application 2007/0065844 (herein incorporated by reference).

In one embodiment, the present invention contemplates a solution-based method for highly multiplexed determination of populations of analyte levels present in a biological sample. For example, the population of target analytes may be a collection of individual target nucleic acids of interest, such as a member of a gene expression signature or just a particular gene of interest. Alternatively, the population of target analytes may be a collection of individual target proteins and/or peptides. Each individual target analyte of interest is conjugated to a detectable solid substrate (i.e., for example, a differentially colored bead) in a quantitative or semi-quantitative manner, such that the level of each target analyte may be measured using a detectable signal generated by the detectable solid substrate. The detectable signal of the detectable solid substrate is sometimes referred to as the target molecule signal or simply as the target signal. The method also involves a population of target-specific bead sets, where each target-specific bead set is individually detectable and has a capture probe which corresponds to an individual analyte. The population of analytes is attached in solution with the population of detectable solid substrates to form a solid substrate-analyte complex. To determine the level of the population of target analytes present, one detects the solid substrate signal for each solid-substrate-analyte complex, such that the level of the solid substrate signal indicates the level of the target analyte, and the location of the solid substrate signal within a multi-modal signal distribution pattern indicates the identity of the analyte being detected.

Limitations of existing bead-based systems is that, due to relatively large microliter-scale volume of sample used per well, each analyte must be assayed with multiple beads of the same type to prevent signal saturation. Similar beads will compete with each other to bind to the same analyte. This situation decreases the sensitivity of the assay because the target analyte present in the sample is distributed over all of the beads specific for that analyte; and each bead will be reporting only a fraction of the analyte concentration. The mean value of the analyte concentration will, therefore, have a large standard error due to variable concentration values reported by each bead. The improvements of bead-based analyte detection described below make possible a highly accurate, and sensitive, high capacity analyte detection system wherein an analyte may be detected using a single bead.

In one embodiment, the present invention contemplates a method which may comprise combining a plurality of 500 bead-set collections in a single well, wherein each collection interrogates a different set of 500 genes. In one embodiment, the method further may comprise detecting the plurality of 500 bead-set collections using the single well. In one embodiment, the method further may comprise generating a multi-modal fluorescent intensity distribution for each of the 500 bead color variations. Although it is not necessary to understand the mechanism of an invention, it is believed that the number of beads that support each multi-modal peak may be determined by determining the local height and width. In one embodiment, the method further may comprise comparing the number of beads within a specific multi-modal peak to the mixing proportion of a bead for a specific gene. In one embodiment, the multi-modal peak bead number matches the bead mixing proportion such that the specific analyte is identified.

As detailed above, the standard commercially available high capacity analyte detection systems are limited to simultaneously processing 500 analytes. While the ability of measuring up to 500 analytes may be sufficient for many applications, this limitation is restrictive for most practical genomics applications. For example, in assessing transcriptome-wide gene expression profiling a practical assay requires a simultaneous processing of much more than 500 genes.

One obvious approach to solve this problem would be to detect more than 500 analytes (i.e., for example, 1,000 genes) by using two wells per sample (i.e., for example, 500 genes per well×2 wells). This technique would then assay a complete collection of 500 differentially dyed bead sets in both wells, where the bead sets in the first well are coupled to genes 1-500 and the bead sets in the second well are couples to genes 501-1000. Consequently, equal aliquots of a biological sample are added to each well and detected separately. In order to determine the final result, the data from the two separate detections would have to be combined.

Several disadvantages are inherent in this approach including but not limited to: i) logistically cumbersome; ii) requires twice as much sample; iii) takes twice as much detection time; iv) loss of one well compromises both wells of data; or v) susceptible to batch artifacts which makes it difficult to re-constitute the whole sample.

In one embodiment, the present invention contemplates a method which may comprise interrogating multiple analytes, wherein said analytes are conjugated to individual, but identical, differentially colored beads. In one embodiment, a first analyte is conjugated to the individual, but identical, differentially colored bead that is selected from a first 500 bead-set. In one embodiment, a second analyte is conjugated to the individual, but identical, differentially colored variant that is selected from a second 500 bead-set.

The Luminex bead-level intensity data distributions suggested that expansion of the system's capacity might be possible by combining two collections of 500 bead-sets in a single well, wherein each 500 bead-set collection interrogates a different set of 500 genes. This approach would allow detection of a single sample in a single well. In some embodiments, various analytical methods are applied to the resulting bead level intensity data to obtain the correct identity for all 1,000 analytes.

Usually, colored bead intensities belonging to a particular bead set are summarized as a single value, wherein a median fluorescent intensity (MFI) is reported as the data point. For example, when the measured analytes are genes, the MFI of a particular bead set color represents the expression value of a particular gene. A significant disadvantage to the median-based algorithm is the presence of inaccuracy if the number of outliers is significantly large (e.g. if a number of beads have an intensity value close to zero), or where low bead counts could lead to misleading MFI values. For example, suggested Luminex data analysis methods ignore data wherein the bead count is less than thirty (30).

In addition to the MFI value, however, Luminex detectors also make available data for each individual bead (e.g., bead-level data). These data are stored in a standard flow cytometry data format (i.e., for example, an LXB file) and include information such as, set membership and/or a fluorescent intensity of each individual bead that is detected. Certain embodiments of the present invention have taken advantage of this alternative data by developing a kernel density based intensity summarization method as an alternative to the default MFI summarization method. In a kernel density method, a smoothed Gaussian density estimate is first fit to the data. A peak detection algorithm then detects local maxima. The most prominent peak (defined as the peak which may comprise the highest bead count) is reported as the summary intensity value. Unlike the standard MFI algorithm, the kernel algorithm may also ignore spurious outliers and/or identify analytes with low bead counts for further consideration. For example, the data presented herein show the differences between intensity distributions for two analytes between MFI values and kernel density based measurements.

Detection and analysis of multimodal peaks have been discussed in relation to mass spectrometry analysis. Old et al., "Methods and systems for peak detection and quantitation" U.S. Pat. No. 7,279,679 (herein incorporated by reference). However, some embodiments of the present invention provide significant improvements that provide superior detection of analytes.

In one embodiment, the present invention contemplates a method which may comprise detecting peaks from a multi-modal fluorescent intensity distribution using an algorithm. In one embodiment, the algorithm recovers an expression value of each gene interrogated with each bead color variation.

In one embodiment, the present invention contemplates a method for improving the accuracy of the peak detection algorithm. In one embodiment, the accuracy is improved by selecting paired genes. In one embodiment, the paired genes are frequently distant. Although it is not necessary to understand the mechanism of an invention, it is believed that a linear programming approach may be employed to maximize the pairwise distances across all genes.

Peak detection usually involves the identification of sufficient statistics comparing different populations from a multimodally distributed signal pattern. For example, the statistical analysis may identify two different populations from a bi-modal distribution signal pattern. Generally, a first step in peak identification involves assigning each data point (i.e., for example, a bead-level data point) to its most salient population. Once these data points have been mapped to their respective population, suitable statistics may be computed (i.e., for example, a median or mean) to summarize the values localized to a population of interest.

A kernel density method may comprise a non-parametric method that does not make assumptions of the underlying distribution of the data. In general, the steps of the KDM algorithm may be performed in the following manner: i) log transform the data; ii) obtain a smoothed Gaussian kernel density estimate. An optimal bandwidth for the kernel is chosen automatically; iii) detect local maxima by comparing each element of the smoothed estimate to its neighboring values. If an element is larger than both of its neighbors, it is a local peak; iv) assign every data point to the nearest peak. The support for a peak is the number of points that are assigned to it; and 5) rank order the peaks according to the support.

Another method, the Gaussian mixture models, assumes that the signal is a mixture of two Gaussian populations.

It should be noted that a GMM parameter estimation may be sensitive to non-Gaussian components of the signal. Consequently, exploratory data analysis has resulted in a definition of a set of heuristics coupled with GMM estimation, which produce accurate peak calls. For example, the data presented herein shows an example output of the GMM for a single analyte measured using the dual tag approach.

In one embodiment, the present invention contemplates a peak detection algorithm further which may comprise a strategy to select paired genes for conjugation to individual, but identical differentially colored beads. In one embodiment, the paired genes are frequently distant. For example, a linear programming approach is used to maximize the pairwise distances across all genes.

In one embodiment, the present invention contemplates a peak detection algorithm further which may comprise a strategy under circumstances where it is difficult to achieve exact mixing proportions of beads, the actual bead counts are measured and then employed as priors within the peak assignment algorithm.

In one embodiment, the detected peak signal may be improved by conjugating every member of an analyte set to the same differentially colored bead. Although it is not necessary to understand the mechanism of an invention, it is believed that multiple analytes on the same bead color will increase the signal-to-noise ratio.

Once peaks within a multimodal distribution pattern have been detected, the peaks need unambiguous assignment to specific genes. In one embodiment, the present invention contemplates a method for unambiguous gene assignment which may comprise combining a plurality of bead-set collections, wherein each differentially colored bead is present in an unequal proportion between each bead-set collection. In one embodiment, a first differentially colored bead may be present in a proportion that is 1.25 times the standard volume selected from a first bead-set collection, while a second differentially colored bead, that is identical to the first differentially colored bead, may be present in a proportion that is 0.75 times the standard volume selected from a second bead-set collection. Then, by examining the support for each peak (e.g. peak height, neighboring bead count or mixing proportion) and using the prior knowledge of the mixing proportion of a bead for a specific gene, an unambiguous assignment for each gene is made.

mRNA expression may be measured by any suitable method, including but not limited to, those disclosed below.

In some embodiments, RNA is detected by Northern blot analysis. Northern blot analysis involves the separation of RNA and hybridization of a complementary labeled probe.

In other embodiments, RNA expression is detected by enzymatic cleavage of specific structures (INVADER assay, Third Wave Technologies; See e.g., U.S. Pat. Nos. 5,846, 717, 6,090,543; 6,001,567; 5,985,557; and 5,994,069; each of which is herein incorporated by reference). The INVADER assay detects specific nucleic acid (e.g., RNA) sequences by using structure-specific enzymes to cleave a complex formed by the hybridization of overlapping oligonucleotide probes.

In still further embodiments, RNA (or corresponding cDNA) is detected by hybridization to a oligonucleotide probe. A variety of hybridization assays using a variety of technologies for hybridization and detection are available. For example, in some embodiments, TaqMan assay (PE Biosystems, Foster City, Calif.; See e.g., U.S. Pat. Nos. 5,962,233 and 5,538,848, each of which is herein incorporated by reference) is utilized. The assay is performed during a PCR reaction. The TaqMan assay exploits the 5'-3' exonuclease activity of the AMPLITAQ GOLD DNA polymerase. A probe consisting of an oligonucleotide with a 5'-reporter dye (e.g., a fluorescent dye) and a 3'-quencher dye is included in the PCR reaction. During PCR, if the probe is bound to its target, the 5'-3' nucleolytic activity of the AMPLITAQ GOLD polymerase cleaves the probe between the reporter and the quencher dye. The separation of the reporter dye from the quencher dye results in an increase of fluorescence. The signal accumulates with each cycle of PCR and may be monitored with a fluorimeter.

In yet other embodiments, reverse-transcriptase PCR (RT-PCR) is used to detect the expression of RNA. In RT-PCR, RNA is enzymatically converted to complementary DNA or "cDNA" using a reverse transcriptase enzyme. The cDNA is then used as a template for a PCR reaction. PCR products may be detected by any suitable method, including but not limited to, gel electrophoresis and staining with a DNA specific stain or hybridization to a labeled probe. In some embodiments, the quantitative reverse transcriptase PCR with standardized mixtures of competitive templates method described in U.S. Pat. Nos. 5,639,606, 5,643,765, and 5,876,978 (each of which is herein incorporated by reference) is utilized.

The method most commonly used as the basis for nucleic acid sequencing, or for identifying a target base, is the enzymatic chain-termination method of Sanger. Traditionally, such methods relied on gel electrophoresis to resolve, according to their size, wherein nucleic acid fragments are produced from a larger nucleic acid segment. However, in recent years various sequencing technologies have evolved which rely on a range of different detection strategies, such as mass spectrometry and array technologies.

One class of sequencing methods assuming importance in the art are those which rely upon the detection of PPi release as the detection strategy. It has been found that such methods lend themselves admirably to large scale genomic projects or clinical sequencing or screening, where relatively cost-effective units with high throughput are needed.

Methods of sequencing based on the concept of detecting inorganic pyrophosphate (PPi) which is released during a polymerase reaction have been described in the literature for example (WO 93/23564, WO 89/09283, WO 98/13523 and WO 98/28440). As each nucleotide is added to a growing nucleic acid strand during a polymerase reaction, a pyrophosphate molecule is released. It has been found that pyrophosphate released under these conditions may readily be detected, for example enzymatically e.g. by the generation of light in the luciferase-luciferin reaction. Such methods enable a base to be identified in a target position and DNA to be sequenced simply and rapidly whilst avoiding the need for electrophoresis and the use of labels.

At its most basic, a PPi-based sequencing reaction involves simply carrying out a primer-directed polymerase extension reaction, and detecting whether or not that nucleotide has been incorporated by detecting whether or not PPi has been released. Conveniently, this detection of PPi-release may be achieved enzymatically, and most conveniently by means of a luciferase-based light detection reaction termed ELIDA (see further below).

It has been found that dATP added as a nucleotide for incorporation, interferes with the luciferase reaction used for PPi detection. Accordingly, a major improvement to the basic PPi-based sequencing method has been to use, in place of dATP, a dATP analogue (specifically dATP$_{alpha}$s) which is incapable of acting as a substrate for luciferase, but which is nonetheless capable of being incorporated into a nucleotide chain by a polymerase enzyme (WO98/13523).

Further improvements to the basic PPi-based sequencing technique include the use of a nucleotide degrading enzyme such as apyrase during the polymerase step, so that unincorporated nucleotides are degraded, as described in WO 98/28440, and the use of a single-stranded nucleic acid binding protein in the reaction mixture after annealing of the primers to the template, which has been found to have a beneficial effect in reducing the number of false signals, as described in WO00/43540.

In other embodiments, gene expression may be detected by measuring the expression of a protein or polypeptide. Protein expression may be detected by any suitable method. In some embodiments, proteins are detected by immunohistochemistry. In other embodiments, proteins are detected by their binding to an antibody raised against the protein. The generation of antibodies is described below.

Antibody binding may be detected by many different techniques including, but not limited to (e.g., radioimmunoassay, ELISA (enzyme-linked immunosorbant assay), "sandwich" immunoassays, immunoradiometric assays, gel diffusion precipitation reactions, immunodiffusion assays, in situ immunoassays (e.g., using colloidal gold, enzyme or radioisotope labels, for example), Western blots, precipitation reactions, agglutination assays (e.g., gel agglutination assays, hemagglutination assays, etc.), complement fixation assays, immunofluorescence assays, protein A assays, and immunoelectrophoresis assays, etc.

In one embodiment, antibody binding is detected by detecting a label on the primary antibody. In another embodiment, the primary antibody is detected by detecting binding of a secondary antibody or reagent to the primary antibody. In a further embodiment, the secondary antibody is labeled.

In some embodiments, an automated detection assay is utilized. Methods for the automation of immunoassays include those described in U.S. Pat. Nos. 5,885,530, 4,981,785, 6,159,750, and 5,358,691, each of which is herein incorporated by reference. In some embodiments, the analysis and presentation of results is also automated. For example, in some embodiments, software that generates a prognosis based on the presence or absence of a series of proteins corresponding to cancer markers is utilized.

In other embodiments, the immunoassay described in U.S. Pat. Nos. 5,599,677 and 5,672,480; each of which is herein incorporated by reference.

In some embodiments, a computer-based analysis program is used to translate the raw data generated by the detection assay (e.g., the presence, absence, or amount of a given marker or markers) into data of predictive value for a clinician. The clinician may access the predictive data using any suitable means. Thus, in some preferred embodiments, the present invention provides the further benefit that the clinician, who is not likely to be trained in genetics or molecular biology, need not understand the raw data. The data is presented directly to the clinician in its most useful form. The clinician is then able to immediately utilize the information in order to optimize the care of the subject.

The present invention contemplates any method capable of receiving, processing, and transmitting the information to and from laboratories conducting the assays, wherein the information is provided to medical personnel and/or subjects. For example, in some embodiments of the present invention, a sample (e.g., a biopsy or a serum or urine sample) is obtained from a subject and submitted to a profiling service (e.g., clinical lab at a medical facility, genomic profiling business, etc.), located in any part of the world (e.g., in a country different than the country where the subject resides or where the information is ultimately used) to generate raw data. Where the sample may comprise a tissue or other biological sample, the subject may visit a medical center to have the sample obtained and sent to the profiling center, or subjects may collect the sample themselves (e.g., a urine sample) and directly send it to a profiling center. Where the sample may comprise previously determined biological information, the information may be directly sent to the profiling service by the subject (e.g., an information card containing the information may be scanned by a computer and the data transmitted to a computer of the profiling center using an electronic communication systems). Once received by the profiling service, the sample is processed and a profile is produced (i.e., expression data), specific for the diagnostic or prognostic information desired for the subject.

The profile data is then prepared in a format suitable for interpretation by a treating clinician. For example, rather than providing raw expression data, the prepared format may represent a diagnosis or risk assessment for the subject, along with recommendations for particular treatment options. The data may be displayed to the clinician by any suitable method. For example, in some embodiments, the profiling service generates a report that may be printed for the clinician (e.g., at the point of care) or displayed to the clinician on a computer monitor.

In some embodiments, the information is first analyzed at the point of care or at a regional facility. The raw data is then sent to a central processing facility for further analysis and/or to convert the raw data to information useful for a clinician or patient. The central processing facility provides the advantage of privacy (all data is stored in a central facility with uniform security protocols), speed, and uniformity of data analysis. The central processing facility may then control the fate of the data following treatment of the subject. For example, using an electronic communication system, the central facility may provide data to the clinician, the subject, or researchers.

In some embodiments, the subject is able to directly access the data using the electronic communication system. The subject may choose further intervention or counseling based on the results. In some embodiments, the data is used for research use. For example, the data may be used to further optimize the inclusion or elimination of markers as useful indicators of a particular condition or stage of disease.

In one embodiment, the present invention contemplates kits for the practice of the methods of this invention. The kits preferably include one or more containers containing various compositions and/or reagents to perform methods of this invention. The kit may optionally include a plurality of cluster centroid landmark transcripts. The kit may optionally include a plurality of nucleic-acid sequences wherein the sequence is complementary to at least a portion of a cluster centroid landmark transcript sequence, and wherein the sequences may optionally comprise a primer sequence and/or a barcode nucleic-acid sequence. The kit may optionally include a plurality of optically addressed beads, wherein each bead may comprise a different nucleic-acid sequence that is complementary to a barcode nucleic-acid sequence.

The kit may optionally include enzymes capable of performing PCR (i.e., for example, DNA polymerase, thermostable polymerase). The kit may optionally include enzymes capable of performing nucleic-acid ligation (for example, a ligase). The kit may optionally include buffers, excipients, diluents, biochemicals and/or other enzymes or proteins. The kits may also optionally include appropriate systems (e.g. opaque containers) or stabilizers (e.g. antioxidants) to prevent degradation of the reagents by light or other adverse conditions.

The kits may optionally include instructional materials containing directions (i.e., protocols) providing for the use of the reagents in the performance of any method described herein. While the instructional materials typically comprise written or printed materials they are not limited to such. Any medium capable of storing such instructions and communicating them to an end user is contemplated by this invention. Such media include, but are not limited to electronic storage media (e.g., magnetic discs, tapes, cartridges, chips), optical media (e.g., CD ROM), and the like. Such media may include addresses to internet sites that provide such instructional materials.

The kits may optionally include computer software (i.e., algorithms, formulae, instrument settings, instructions for robots, etc) providing for the performance of any method described herein, simplification or automation of any method described herein, or manipulation, analysis, display or visualization of data generated thereby. Any medium capable of storing such software and conveying it to an end user is contemplated by this invention. Such media include, but are not limited to, electronic storage media (e.g., magnetic discs), optical media (e.g., CD ROM), and the like. Such media may include addresses to internet sites that provide such software.

In other embodiments, the present invention provides kits for the detection and characterization of proteins and/or nucleic acids. In some embodiments, the kits contain antibodies specific for a protein expressed from a gene of interest, in addition to detection reagents and buffers. In other embodiments, the kits contain reagents specific for the detection of mRNA or cDNA (e.g., oligonucleotide probes or primers). In preferred embodiments, the kits contain all of the components necessary to perform a detection assay, including all controls, directions for performing assays, and any necessary software for analysis and presentation of results.

Samples (i.e., for example, biological samples) may be optionally concentrated using a commercially available concentration filter, for example, an Amicon or Millipore Pellicon ultrafiltration unit. Following the concentration step, the concentrate may be applied to a suitable purification matrix as previously described. For example, a suitable affinity matrix may comprise a ligand or antibody molecule bound to a suitable support. Alternatively, an anion exchange resin may be employed, for example, a matrix or substrate having pendant diethylaminoethyl (DEAE) groups. The matrices may be acrylamide, agarose, dextran, cellulose or other types commonly employed in protein purification. Alternatively, a cation exchange step may be employed. Suitable cation exchangers include various insoluble matrices which may comprise sulfopropyl or carboxymethyl groups. Sulfopropyl groups are preferred.

Finally, one or more reversed-phase high performance liquid chromatography (RP-HPLC) steps employing hydrophobic RP-HPLC media, e.g., silica gel having pendant methyl or other aliphatic groups, may be employed to further purify an IL-1R composition. Some or all of the foregoing purification steps, in various combinations, may also be employed to provide a substantially pure recombinant protein.

Protein may be isolated by initial extraction from cell pellets, followed by one or more concentration, salting-out, hydrophobic interaction chromatography (HIC), aqueous ion exchange or size exclusion chromatography steps. Finally, high performance liquid chromatography (HPLC) may be employed for final purification steps. Most biological cells may be disrupted by any convenient method, including freeze-thaw cycling, sonication, mechanical disruption, or use of cell lysing agents.

The present invention provides isolated antibodies (i.e., for example, polyclonal or monoclonal). In one embodiment, the present invention provides antibodies that specifically bind to a subset of a solid particle population. These antibodies find use in the detection methods described above.

An antibody against a protein of the present invention may be any monoclonal or polyclonal antibody, as long as it may recognize the protein. Antibodies may be produced by using a protein of the present invention as the antigen according to a conventional antibody or antiserum preparation process.

The present invention contemplates the use of both monoclonal and polyclonal antibodies. Any suitable method may be used to generate the antibodies used in the methods and compositions of the present invention, including but not limited to, those disclosed herein. For example, for preparation of a monoclonal antibody, protein, as such, or together with a suitable carrier or diluent is administered to an animal (e.g., a mammal) under conditions that permit the production of antibodies. For enhancing the antibody production capability, complete or incomplete Freund's adjuvant may be administered. Normally, the protein is administered once every 2 weeks to 6 weeks, in total, about 2 times to about 10 times. Animals suitable for use in such methods include, but are not limited to, primates, rabbits, dogs, guinea pigs, mice, rats, sheep, goats, etc.

For preparing monoclonal antibody-producing cells, an individual animal whose antibody titer has been confirmed (e.g., a mouse) is selected, and 2 days to 5 days after the final immunization, its spleen or lymph node is harvested and antibody-producing cells contained therein are fused with myeloma cells to prepare the desired monoclonal antibody producer hybridoma. Measurement of the antibody titer in antiserum may be carried out, for example, by reacting the labeled protein, as described hereinafter and antiserum and then measuring the activity of the labeling agent bound to the antibody. The cell fusion may be carried out according to known methods, for example, the method described by Koehler and Milstein (Nature 256:495 [1975]). As a fusion promoter, for example, polyethylene glycol (PEG) or Sendai virus (HVJ), preferably PEG is used.

Examples of myeloma cells include NS-1, P3U1, SP2/0, AP-1 and the like. The proportion of the number of antibody producer cells (spleen cells) and the number of myeloma cells to be used is preferably about 1:1 to about 20:1. PEG (preferably PEG 1000-PEG 6000) is preferably added in concentration of about 10% to about 80%. Cell fusion may be carried out efficiently by incubating a mixture of both cells at about 20° C. to about 40° C., preferably about 30° C. to about 37° C. for about 1 minute to 10 minutes.

Various methods may be used for screening for a hybridoma producing the antibody (e.g., against a tumor antigen or autoantibody of the present invention). For example, where a supernatant of the hybridoma is added to a solid phase (e.g., microplate) to which antibody is adsorbed directly or together with a carrier and then an anti-immunoglobulin antibody (if mouse cells are used in cell fusion, anti-mouse immunoglobulin antibody is used) or Protein A labeled with a radioactive substance or an enzyme is added to detect the monoclonal antibody against the protein bound to the solid phase. Alternately, a supernatant of the hybridoma is added to a solid phase to which an anti-immunoglobulin antibody or Protein A is adsorbed and then the protein labeled with a radioactive substance or an enzyme is added to detect the monoclonal antibody against the protein bound to the solid phase.

Selection of the monoclonal antibody may be carried out according to any known method or its modification. Normally, a medium for animal cells to which HAT (hypoxanthine, aminopterin, thymidine) are added is employed. Any selection and growth medium may be employed as long as the hybridoma may grow. For example, RPMI 1640 medium containing 1% to 20%, preferably 10% to 20% fetal bovine serum, GIT medium containing 1% to 10% fetal bovine serum, a serum free medium for cultivation of a hybridoma (SFM-101, Nissui Seiyaku) and the like may be used. Normally, the cultivation is carried out at 20° C. to 40° C., preferably 37° C. for about 5 days to 3 weeks, preferably 1 week to 2 weeks under about 5% $CO_2$ gas. The antibody titer of the supernatant of a hybridoma culture may be measured according to the same manner as described above with respect to the antibody titer of the anti-protein in the antiserum.

Separation and purification of a monoclonal antibody may be carried out according to the same manner as those of conventional polyclonal antibodies such as separation and purification of immunoglobulins, for example, salting-out, alcoholic precipitation, isoelectric point precipitation, electrophoresis, adsorption and desorption with ion exchangers (e.g., DEAE), ultracentrifugation, gel filtration, or a specific purification method wherein only an antibody is collected with an active adsorbent such as an antigen-binding solid phase, Protein A or Protein G and dissociating the binding to obtain the antibody.

Polyclonal antibodies may be prepared by any known method or modifications of these methods including obtaining antibodies from patients. For example, a complex of an immunogen (an antigen against the protein) and a carrier protein is prepared and an animal is immunized by the complex according to the same manner as that described with respect to the above monoclonal antibody preparation. A material containing the antibody against is recovered from the immunized animal and the antibody is separated and purified.

As to the complex of the immunogen and the carrier protein to be used for immunization of an animal, any carrier protein and any mixing proportion of the carrier and a hapten may be employed as long as an antibody against the hapten, which is crosslinked on the carrier and used for immunization, is produced efficiently. For example, bovine serum albumin, bovine cycloglobulin, keyhole limpet hemocyanin, etc. may be coupled to a hapten in a weight ratio of about 0.1 part to about 20 parts, preferably, about 1 part to about 5 parts per 1 part of the hapten.

In addition, various condensing agents may be used for coupling of a hapten and a carrier. For example, glutaraldehyde, carbodiimide, maleimide activated ester, activated ester reagents containing thiol group or dithiopyridyl group, and the like find use with the present invention. The condensation product as such or together with a suitable carrier or diluent is administered to a site of an animal that permits the antibody production. For enhancing the antibody production capability, complete or incomplete Freund's adjuvant may be administered. Normally, the protein is administered once every 2 weeks to 6 weeks, in total, about 3 times to about 10 times.

The polyclonal antibody is recovered from blood, ascites and the like, of an animal immunized by the above method. The antibody titer in the antiserum may be measured according to the same manner as that described above with respect to the supernatant of the hybridoma culture. Separation and purification of the antibody may be carried out according to the same separation and purification method of immunoglobulin as that described with respect to the above monoclonal antibody.

The protein used herein as the immunogen is not limited to any particular type of immunogen. For example, a protein expressed resulting from a virus infection (further including a gene having a nucleotide sequence partly altered) may be used as the immunogen. Further, fragments of the protein may be used. Fragments may be obtained by any methods including, but not limited to expressing a fragment of the gene, enzymatic processing of the protein, chemical synthesis, and the like.

Although the present invention and its advantages have been described in detail, it should be understood that various changes, substitutions and alterations may be made herein without departing from the spirit and scope of the invention as defined in the appended claims.

The present invention will be further illustrated in the following Examples which are given for illustration purposes only and are not intended to limit the invention in any way.

EXAMPLES

Example 1: Identification of Cluster Centroid Landmark Transcripts and Creation of a Dependency Matrix The present example describes one method for the identification of cluster centroid landmark transcripts having inferential relationships.

Thirty-five thousand eight-hundred and sixty-seven transcriptome-wide gene-expression profiles generated with the Affymetrix U133 family of oligonucleotide microarrays were downloaded from NCBI's Gene Expression Omnibus (GEO) repository in the form of .cel files. The .cel files were preprocessed to produce average-difference values (i.e. expression levels) for each probe set using MAS5 (Affymetrix). Expression levels in each profile were then scaled with respect to the expression levels of 350 previously-determined invariant probe sets whose expression levels together spanned the range of expression levels observed. The minimal common feature space in the dataset was determined to be 22,268 probe sets.

The quality of each profile was assessed by reference to two data-quality metrics: percentage of P-calls and 3':5' ratios. Empirical distributions of both metrics were built and the 10% of profiles at both extremes of each distribution were eliminated from further consideration. A total of 16,428 profiles remained after this quality filtering. A further 1,941 profiles were found to be from a single source, and were also eliminated.

Probe sets below a predetermined arbitrary detection threshold of 20 average-difference units in over 99% of the profiles were eliminated, bringing the total number of probe sets under consideration to 14,812.

Principal component analysis (PCA) dimensionality reduction was then applied to the dataset (i.e. 14,487 samples×14,812 features). Two-hundred eight-seven components were identified that explained 90% of the variation in the dataset. The matrix of the PCA loadings of the features in the eigenspace (i.e. 287×14,812) was then clustered using k-means. The k-means clustering was repeated a number of times because the high-dimensionality matrix obtained partitions non-deterministically based on the starting seeds, and the results were used to build a gene-by-gene pairwise consensus matrix.

Pockets of high local correlation were identified by hierarchically clustering the gene-by-gene pairwise consensus matrix. The leaves on each node of the dendrogram 'tree' together constitute a cluster. The tree was then cut a multiple levels to identify 100, 300, 500, 700, 1,000, 1,500, 2,000, 5,000, and 10,000 clusters.

The probe sets whose individual expression-level vector across all 14,487 profiles most closely correlated with that of the mean of all probe sets in each cluster was selected as the centroid of that cluster. This produced sets of 100, 300, 500, 700, 1,000, 1,500, 2,000, 5,000, and 10,000 centroid probe sets. Multiple individual probe sets had attributes that approximate the definition of a centroid probe set of any given cluster.

A dependency matrix was created for each set of centroid probe sets by linear regression between the expression levels of the g centroid probe sets and the remaining 14,812-g probe sets in the space of the 14,487 profiles. A pseudo-inverse was used because the number of profiles did not necessarily match the number of features being modeled. Dependency matrices were thereby populated with weights (i.e. factors) relating the expression level of each non-centroid probe set to the expression level of each centroid probe set.

The identity and gene symbol of the transcript represented by each centroid probe set was determined using a mapping provided by Affymetrix (affymetrix.com) and taken as a 'cluster centroid landmark transcript.' Non-centroid probe sets were mapped to gene symbols in the same manner.

Example II: Determining a Suitable Number of Cluster Centroid Landmark Transcripts The present example describes one method for selecting the number of cluster centroid landmark transcripts required to create useful transcriptome-wide gene-expression profiles. This method makes use of a large collection of transcriptome-wide gene-expression profiles produced from cultured human cells treated with small-molecule perturbagens made with Affymetrix oligonucleotide microarrays provided in build02 of the public Connectivity Map resource (broadinstitute.org/cmap). One use of Connectivity Map is the identification of similarities between the biological effects of small-molecule perturbagens. This is achieved by detecting similarities in the gene-expression profiles produced by treating cells with those perturbagens (Lamb et al., "The Connectivity Map: using gene-expression signatures to connect small molecules, genes and disease" *Science* 313:1929 2006), and represents one valuable application of transcriptome-wide gene-expression profiling. In summary of the present method, expression values for the sets of cluster centroid landmark transcripts (specifically their corresponding probe sets) identified according to Example I (above) are extracted from the Connectivity Map data and used to create transcriptome-wide gene-expression profiles using the dependency matrices generated also according to Example I (above). Note that the collection of expression profiles used in Example I did not include any Connectivity Map data. The proportion of similarities identified using the actual transcriptome-wide gene-expression profiles also identified by the inferred transcriptome-wide gene-expression profiles created from different numbers of cluster centroid landmark transcript measurements are then compared.

First, a matrix of enrichment scores was constructed by executing 184 independent query signatures obtained from Lamb et al. and the Molecular Signatures Database (MSigDB; release 1.5; broadinstitute.org/gsea/msigdb) against the full Connectivity Map dataset, as described (Lamb et al.) producing a 'reference connectivity matrix' (i.e. 184 queries×1,309 treatments).

The 7,056 transcriptome-wide gene-expression profiles were downloaded from the Connectivity Map website in the form of .cel files. The .cel files were then preprocessed to produce average-difference values (i.e. expression levels) for each probe set using MAS5 (Affymetrix). Expression levels for each set of centroid probe sets were extracted, and 9×7,056 sets of transcriptome-wide gene-expression profiles created using the corresponding dependency matrices; expression levels of non-centroid probe sets were computed by multiplying the expression levels for each centroid probe set by their dependency-matrix factors and summed. Rank-ordered lists of probe sets were computed for each treatment-and-vehicle pair using these (inferred) transcriptome-wide gene-expression profiles as described (Lamb et al.). Matrices of enrichment scores were created for each of the 9 datasets with the set of 184 query signatures exactly as was done to create the reference connectivity matrix.

The number of query signatures for which the treatment with the highest enrichment score in the reference connectivity matrix was also the top scoring treatment in the connectivity matrix produced from each of the 9 inferred datasets was plotted (FIG. 2). The dataset generated using expression values for only 1,000 centroid probe sets identified the same treatment as the dataset generated using expression values for all 22,283 probe sets in 147 of 184 (80%) of cases. These findings indicate that 1,000 cluster centroid landmark transcripts may be used to create useful transcriptome-wide gene-expression profiles.

Example III: Platform-Specific Selection of Cluster Centroid Landmark Transcripts This example describes one method for validating the performance of cluster centroid landmark transcripts on a selected moderate-multiplex assay platform. This example relates specifically to the measurement of expression levels of cluster centroid landmark transcripts derived from gene-expression profiles generated using Affymetrix microarrays using the LMF method of Peck et al., "A method for high-throughput gene expression signature analysis" *Genome Biology* 7:R61 (2006). See FIG. 3.

Figure 4:
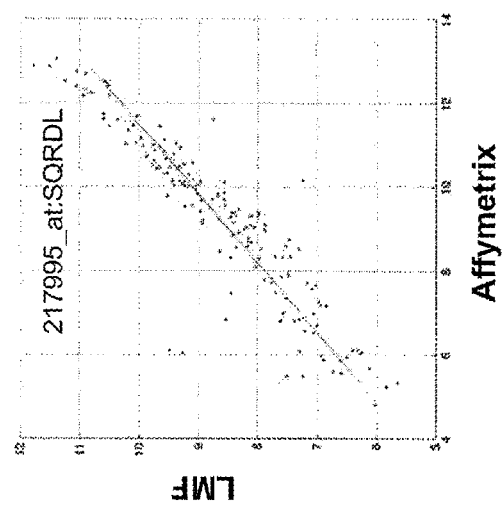
FIG. 4 presents exemplary data for normalized expression levels of a representative cluster centroid landmark transcript (217995_at:SQRDL) in 384 biological samples measured by LMF and Affymetrix microarray.

Probe pairs were designed for 1,000 cluster centroid landmark transcripts selected according to Example I (above) as described by Peck et al. The expression levels of these transcripts were measured by LMF in a collection of 384 biological samples which may comprise unperturbed cell lines, cell lines treated with bioactive small molecules, and tissue specimens for which transcriptome-wide gene-expression profiles generated using Affymetrix microarrays was available. A plot of normalized expression level measured by LMF against normalized expression level measured by Affymetrix microarray for a representative cluster centroid landmark transcript (217995_at:SQRDL) across all 384 biological samples is shown as FIG. 4. Vectors of expression levels across all 384 samples were constructed for every feature from both measurement platforms.

For each cluster centroid landmark transcript, the corresponding LMF vector was used as the index in a nearest-neighbors analysis to rank the Affymetrix probe sets. Cluster centroid landmark transcripts were considered to be 'validated' for measurement by LMF when the Affymetrix probe set mapping to that cluster centroid landmark transcript had a rank of 5 or greater, and the Affymetrix probe sets mapping to 80% or more of the non-centroid transcripts in the corresponding cluster had a rank of 100 or greater.

Figure 5:
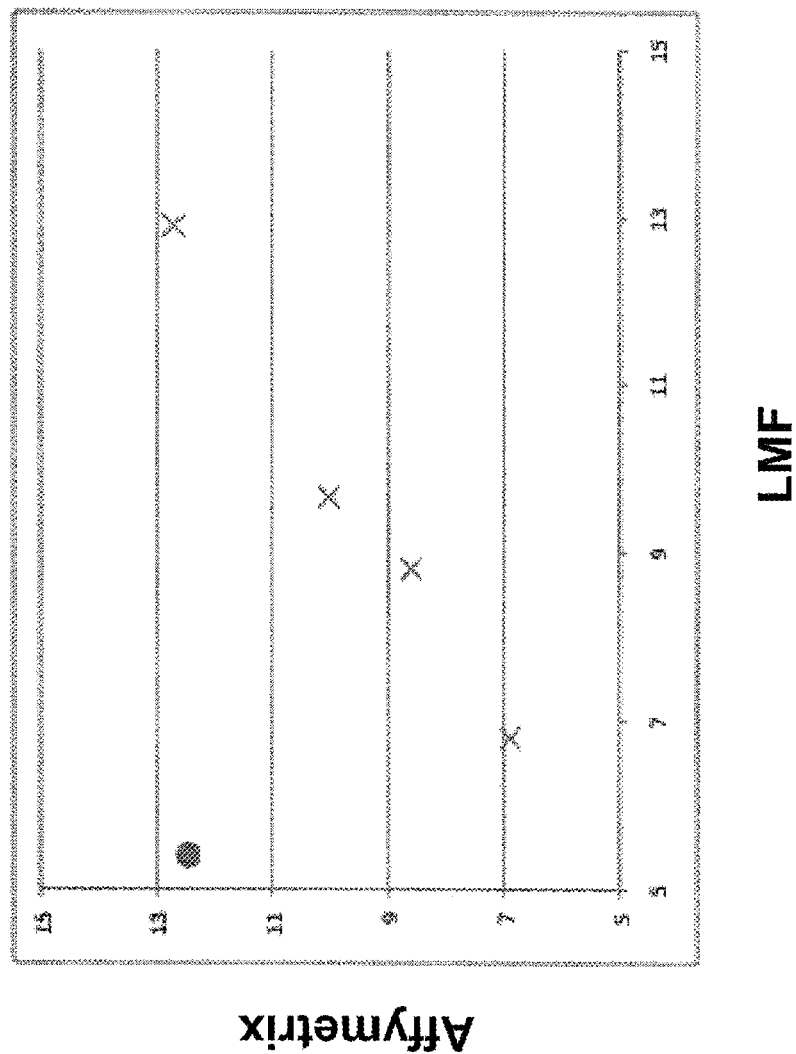
FIG. 5 presents exemplary data showing a simple (type 1) cluster centroid landmark transcript validation failure; circle. Axes are normalized expression levels.
Figure 6:
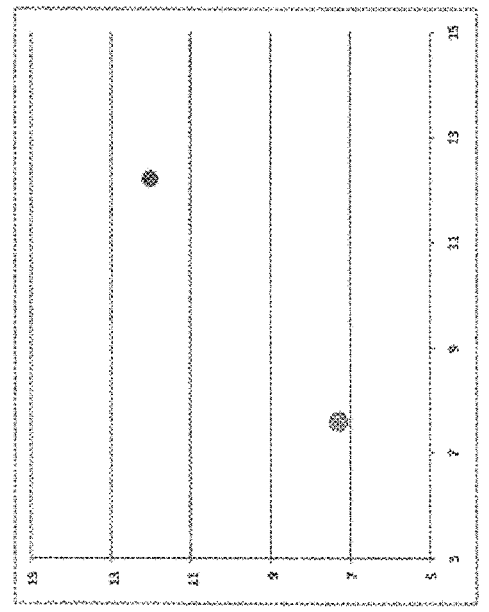
FIG. 6 presents exemplary data showing a complex (type 2) cluster centroid landmark transcript validation failure.
Figure 6:
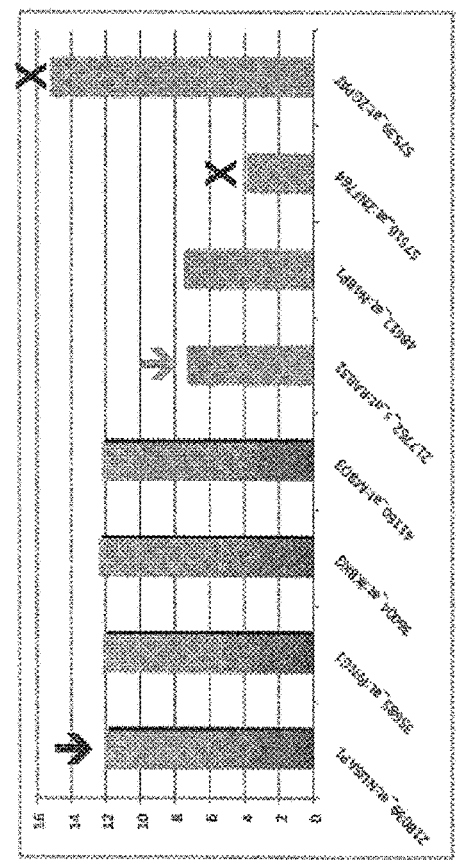

Not all attempts to create validated cluster centroid landmark transcripts were successful. Transcripts failing to meet the validation criteria were found to be of two types: (1) simple, where the measurements of the centroid transcript itself were poorly correlated across the 384 samples; and (2) complex, where the measurements of the centroid transcripts were well correlated but those levels were not well correlated with those of the non-centroid transcripts from its cluster. Neither type of failure could be anticipated. A plot of normalized expression levels determined by LMF and Affymetrix microarray for three validated transcripts (218039_at:NUSAP1, 201145_at:HAX1, 217874_at:SUCLG1), one representative type-1 failure (202209_at:LSM3), and one representative type-2 failure (217762_at:RAB31) in one of the 384 biological samples is presented as FIG. 5. A plot of normalized expression levels determined by LMF and Affymetrix microarray for one of these validated transcripts and the same representative type-2 failure in a different one of the 384 biological samples is presented as FIG. 6A. FIG. 6B shows the expression levels of the same transcripts in the same biological sample together with those of three transcripts from their clusters (measured using Affymetrix microarray only). Only the expression level of the validated transcript (218039_at:NUSAP1) is correlated with the levels of the transcripts in its cluster (35685_at:RING1, 36004_at:IKBKG, 41160_at:MBD3). The expression level of the type-2 failed transcript (217762_at:RAB31) is not correlated with the levels of all of the transcripts in its cluster (48612_at:N4BP1, 57516_at:ZNF764, 57539_at:ZGPAT). A representative list of transcripts exhibiting simple (type 1) failures, together with the gene-specific portions of their LMF probe pairs, is provided as Table 1. A representative list of transcripts exhibiting complex (type 2) failures, together with the gene-specific portions of their LMF probe pairs is provided as Table 2.

The use of alternative probe pairs allowed a proportion of failed cluster centroid landmark transcripts to be validated. When this was not successful, failed cluster centroid landmark transcripts were substituted with other transcripts from the same cluster. This process was continued until validated cluster centroid landmark transcripts for all 1,000 clusters were obtained. The list of these landmark transcripts, together with the gene-specific portions of their corresponding LMF probe pairs, is provided in Table 3. A dependency matrix specific for this set of validated landmark transcripts was created according to Example I (above).

Example IV: Generation and Use of Transcriptome-Wide Gene-Expression Profiles Made by Measurement of 1,000 Transcripts This example described one method for the generation of transcriptome-wide gene-expression profiles using measurement of the expression levels of a sub-transcriptome number of cluster centroid landmark transcripts. The present method uses the LMF moderate multiplex gene-expression analysis platform described by Peck et al. ("A method for high-throughput gene expression signature analysis" *Genome Biology* 7:R61 2006), the Luminex FlexMAP 3D optically-addressed microspheres and flow-cytometric detection system, 1,000 cluster centroid landmark transcripts (and corresponding gene-specific sequences) validated for LMF from Example III (above), a corresponding dependency matrix from Example III (above), 50 empirically-determined invariant transcripts with expression levels spanning the range of those observed, and 1,050 barcode sequences developed. The FlexMAP 3D system allows simultaneous quantification of 500 distinct analytes in samples arrayed in the wells of a 384-well plate. Measurement of the expression levels of 1,000 landmark transcripts plus 50 invariant transcripts was therefore divided over 3 wells. Four hundred landmark transcripts were assayed in one well, and three hundred landmark transcripts were assayed in each of 2 additional wells. The 50 invariant genes were assayed in all 3 wells. This overall method, referred to herein as L1000, was then used to generate a total of 1,152 transcriptome-wide gene-expression profiles from cultured human cells treated with each of 137 distinct bioactive small molecules. These data were used to create an analog of a small portion of Connectivity Map de novo, and the relative performance of the L1000 version compared to that of the original.

LMF probe pairs were constructed for each of the 1,000 landmark and 50 invariant transcripts such that each pair incorporated one of the 1,050 barcode sequences. Probes were mixed in equimolar amounts to form a probe-pair pool. Capture probes complementary to each of the barcode sequences were obtained and coupled to one of 500 homogenous populations of optically-distinguishable microspheres using standard procedures. Three pools of capture-probe expressing microspheres were created: one pool contained beads coupled to capture probes complementary to the barcodes in 400 of the landmark probe pairs, a second pool contained beads matching a different 300 landmark probes, and a third pool contained beads matching the remaining 300 landmark probes. Each pool contained beads expressing barcodes matching the probe pairs corresponding to the 50 invariant transcripts.

MCF7 cells were treated with small molecules and corresponding vehicles in 384-well plates. Cells were lysed, mRNA captured, first-strand cDNA synthesized, and ligation-mediated amplification performed using the 1,000 landmark plus 50 invariant transcript probe-pair pool in accordance with the published LMF method (Peck et al.). The amplicon pools obtained after the PCR step were divided between 3 wells of fresh 384-well plates, and each hybridized to one of the three bead pools at a bead density of approximately 500 beads of each address per well, also in accordance with the published LMF method. The captured amplicons were labeled with phycoerythrin and the resulting microsphere populations were analyzed using a FlexMAP 3D instrument in accordance with the manufacturer's instructions.

Median fluorescence intensity (MFI) values from each microsphere population from each detection well were associated with their corresponding transcript and sample. MFI values for each landmark transcript were scaled relative to those for the set of invariant transcripts obtained from the same detection well, and all scaled MFI values derived from the same samples were concatenated to produce a list of normalized expression levels for each of the 1,000 landmark transcripts in each treatment sample.

Predicted expression levels for transcripts that were not measured were calculated by multiplying the expression levels of each of the landmark transcripts by the weights contained in the dependency matrix, and summed. Computed and measured expression levels were combined to create full-transcriptome gene-expression profiles for each sample. Rank-ordered lists of transcripts were computed for each pair of treatment and corresponding vehicle-control profiles as described by Lamb et al. ("The Connectivity Map: using gene-expression signatures to connect small molecules, genes and disease" *Science* 313: 1929-1935 2006), resulting in an analog of the Connectivity Map dataset containing a total of 782 small-molecule treatment instances.

Figure 7:
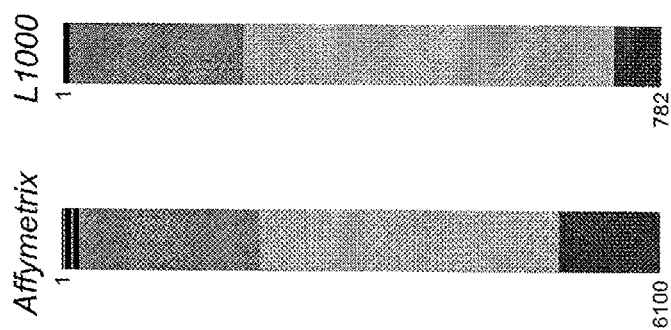
FIG. 7 presents exemplary data comparing the performance of Connectivity Map datasets populated with gene-expression profiles generated with Affymetrix microarrays reporting on approximately 22,000 transcripts (left), and a ligation-mediated amplification and Luminex optically-addressed microsphere assay of 1,000 landmark transcripts with inference of the expression levels of the remaining transcripts (right). Both datasets were queried with an independent HDAC-inhibitor query signature. The 'bar views' shown are constructed from 6,100 and 782 horizontal lines, respectively, each representing individual treatment instances and ordered by connectivity score. All instances of the HDAC-inhibitor, vorinostat, are colored in black. Colors applied to the remaining instances reflect their connectivity scores (green, positive; gray, null; red, negative).

Enrichment scores for each of the perturbagens in the original Connectivity Map (created with Affymetrix microarrays) and the L1000 analog were computed according to the method of Lamb et al. for a published query signature derived from an independent transcriptome-wide gene-expression analysis of the effects of three biochemically-verified histone-deacetylase (HDAC) inhibitor compounds. Glaser et al., "Gene expression profiling of multiple histone deacetylase (HDAC) inhibitors: defining a common gene set produced by HDAC inhibition in T24 and MDA carcinoma cell lines." *Mol Cancer Ther* 2:151-163 (2003). As anticipated, the small molecule with the highest score in the original Affymetrix Connectivity Map was vorinostat, an established HDAC inhibitor (enrichment score=0.973, n=12, p-value<0.001). However, vorinostat was also the highest scoring perturbagen in the L1000 dataset (score=0.921, n=8, p-value<0.001). See FIG. 7. An additional 95 query signatures were executed against both datasets. The perturbagen with the highest score in the original Connectivity Map also had the highest score of those in the L1000 dataset in 79 (83%) of those cases.

These data show that L1000 may substitute for a technology that directly measures the expression levels of all transcripts in the transcriptome—specifically, Affymetrix high-density oligonucleotide microarrays—in one useful application of transcriptome-wide gene-expression profiling.

Example V: Use of Transcriptome-Wide Gene-Expression Profiles Made by Measurement of 1,000 Transcripts for Clustering of Cell Lines Transcriptome-wide gene-expression profiles were generated from total RNA isolated from 44 cultured human cancer cells lines derived from six tissue types using measurement of the expression levels of a sub-transcriptome number of cluster centroid transcripts and inference of the remaining transcripts according to the L1000 methods described in Example IV. Full-transcriptome gene-expression data were produced from these same total RNA samples using Affymetrix U133 Plus 2.0 high-density oligonucleotide microarrays for comparison.

Cell lines were grouped together according to consensus hierarchical clustering of their corresponding gene-expression profiles (Monti et al "Consensus Clustering: A resampling-based method for class discovery and visualization of gene expression microarray data." *Machine Learning Journal* 52: 91-118 2003). The similarity metric used was Pearson correlation. One hundred twenty-five clustering iterations were made. In each iteration, 38 (85%) of the samples were used and 6 excluded.

Figure 8:
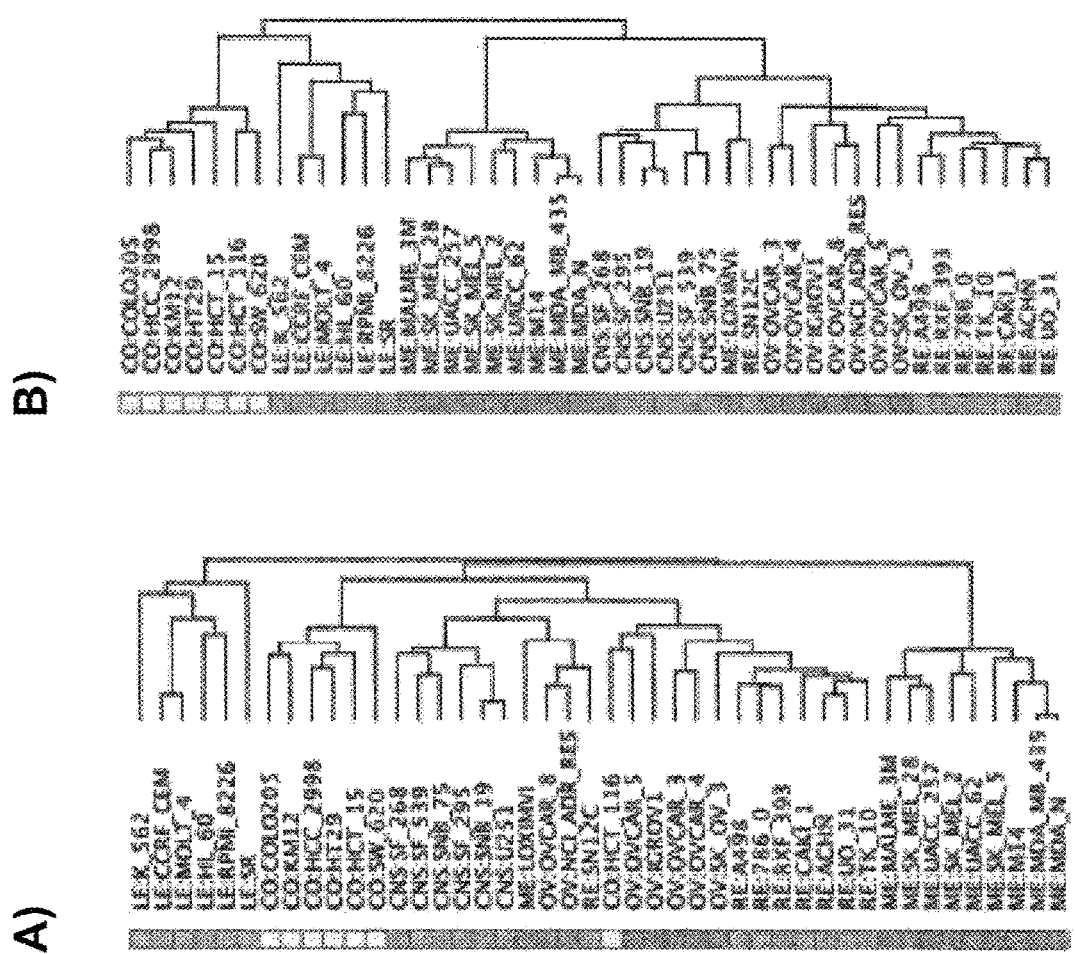
FIG. 8 presents exemplary data comparing consensus clustering dendrograms of gene-expression profiles for human cell lines generated with Affymetrix microarrays (A), and one embodiment of a landmark transcript measurement and inference method as contemplated herein (B). Tissue types are: CO=colon; LE=blood (leukemia); ME=skin (melanoma); CNS=brain (central nervous system); OV=ovary; and RE=kidney (renal).

As anticipated, the results of the consensus clustering made with the Affymetrix data placed cell lines from the same tissue in the same branch of the dendrogram, with only few exceptions (FIG. 8A). Many similar such findings have been reported. Ross et al., "Systematic variation in gene expression patterns in human cancer cell lines" *Nature Genetics* 24: 227-235 2000). Remarkably, clustering of the L1000 data also placed cell lines with the same tissues of origin in the same branch of the dendrogram (FIG. 8B).

This example shows that L1000 may substitute for a technology that directly measures the expression levels of all transcripts in the transcriptome-specifically, Affymetrix high-density oligonucleotide microarrays—in a second useful application of transcriptome-wide gene-expression profiling; that is, grouping of samples on the basis of biological similarity.

Example VI: Use of Transcriptome-Wide Gene-Expression Profiles Made by Measurement of 1,000 Transcripts for Gene-Set Enrichment Analysis The expression levels of 1,000 cluster centroid transcripts were measured in primary human macrophages following treatment with lipopolysaccharide (LPS) or vehicle control, and used to create gene-expression profiles composed of expression levels for 22,268 transcripts, according to the L1000 methods described in Example IV. These data were used as input for a Gene-Set Enrichment Analysis (GSEA) with a library of 512 gene sets from version 3 of the Molecular Signatures Database (Subramanian et al., "Gene set enrichment analysis: A knowledge-based approach for interpreting genome-wide expression profiles" *Proc Natl Acad Sci* 102: 15545-15550 2005).

LPS is known to be a potent activator of the NF-κB transcription-factor complex (Qin et al., "LPS induces CD40 gene expression through the activation of NF-κB and STAT-1a in macrophages and microglia" *Blood* 106: 3114-3122 2005). It was therefore not unexpected that a gene set composed of 23 members of the canonical NF-κB signaling pathway (BIOCARTA_NFKB_PATHWAY) received the highest score of all gene sets tested (p<0.001). This example shows that L1000 may generate data compatible with a third useful application of full-transcriptome gene-expression profiling; that is, gene-set enrichment analysis. However, closer examination of the analysis revealed that none of the 23 transcripts in the BIOCARTA_NFKB_PATHWAY gene set had been explicitly measured. This example then also demonstrates the utility of the method even in the extreme case when the expression levels of all of the transcripts of interest were inferred.

Example VII: Creation of a Full-Transcriptome Gene-Expression Dataset of Unprecedented Size The L1000 methods described in Example IV were used to create a connectivity map with in excess of 100,000 full-transcriptome gene-expression profiles from a panel of cultured human cells treated with a diversity of chemical and genetic perturbations at a range of doses and treatment durations.

Creation of a dataset of this size is impractical with existing transcriptome-wide gene-expression profiling technologies (e.g. Affymetrix GeneChip) due to high cost and low throughput. This example therefore demonstrates the transformative effect of the present invention on the field of gene-expression profiling in general, and its potential to impact medically-relevant problems in particular.

TABLE 1

Representative Type I (simple) Landmark Transcript/Probe-Pair Failures
(SEQ ID NOS 1-134, respectively, in order of appearance)

| ## | name | alternate name | left probe sequence | right probe sequence |
|---|---|---|---|---|
| 1 | FFA6B6 | 200058_s_at:SNRNP200 | CCATCAAGAGGCTGACCTTG | CAGCAGAAGGCCAAGGTGAA |
| 2 | RE1F1 | 200064_at:HSP90AB1 | GGCGATGAGGATGCGTCTCG | CATGGAAGAAGTCGATTAGG |
| 3 | YC7D7 | 200729_s_at:ACTR2 | GAAAATCCTATTTATGAATC | CTGTCGGTATTCCTTGGTAT |
| 4 | GGG6H6 | 200792_at:XRCC6 | TGCTGGAAGCCCTCACCAAG | CACTTCCAGGACTGACCAGA |
| 5 | CC1D1 | 200870_at:STRAP | GTGTCAGATGAAGGGAGGTG | GAGTTATCCTCTTATAGTAC |
| 6 | AG12H12 | 200991_s_at:SNX17 | TTCTCTTGGCCAGGGGCCTC | GTATCCTACCTTTCCTTGTC |
| 7 | DDC7D7 | 201488_x_at:KHDRBS1 | TCTTGTATCTCCCAGGATTC | CTGTTGCTTTACCCACAACA |
| 8 | BBA1B1 | 201511_at:AAMP | CACGTCAGGAGACCACAAAG | CGAAAGTATTTTGTGTCCAA |
| 9 | LG12H12 | 201620_at:MBTPS1 | CAGGGGAAGGATGTACTTTC | CAAACAAATGATACAACCCT |
| 10 | YC12D12 | 201652_at:COPS5 | AAAGTTAGAGCAGTCAGAAG | CCCAGCTGGGACGAGGGAGT |
| 11 | FFE11F11 | 201683_x_at:TOX4 | AATGACAGACATGACATCTG | GCTTGATGGGGCATAGCCAG |
| 12 | FFG11H11 | 201684_s_at:TOX4 | TTATCTGCTGGGAAAGTGTC | CAAGAGCCTGTTTTTGAAAC |
| 13 | OG3H3 | 201696_at:SFRS4 | TAACCTGGACGGCTCTAAGG | CTGGAATGACCACATAGGTA |
| 14 | YA1B1 | 201710_at:MYBL2 | ATGTTTACAGGGGTTGTGGG | GGCAGAGGGGTCTGTGAAT |
| 15 | VC3D3 | 201729_s_at:KIAA0100 | GGCAGGCGCAAATGATTTGG | CGATTCGAGTGGCTGCAGTA |
| 16 | AAC9D9 | 201773_at:ADNP | ACTTAGTTTTTGCACATAAC | CTTGTACAATCTTGCAACAG |
| 17 | BBA7B7 | 201949_x_at:CAPZB | AGCTCTGGGAGCAGAGGTGG | CCCTCGGTGCCGTCCTGCGC |
| 18 | CCE4F4 | 202116_at:DPF2 | TTGTTCTTCCTGGACCTGGG | CATTCAGCCTCCTGCTCTTA |
| 19 | ME8F8 | 202123_s_at:ABL1 | CGACTGCCTGTCTCCATGAG | GTACTGGTCCCTTCCTTTTG |
| 20 | UUA11B11 | 202178_at:PRKCZ | CACGGAAACAGAACTCGATG | CACTGACCTGCTCCGCCAGG |
| 21 | MA1B1 | 202261_at:VPS72 | TGTTCCGTTTCTTCTCCCTG | CTTCTCCCCTTTGTCATCTC |
| 22 | RG1H1 | 202298_at:NDUFA1 | GCTCATTTGGGTATCACTG | GAGTCTGATGGAAAGAGATA |
| 23 | OE2F2 | 202408_s_at:PRPF31 | CCGCCCAGTATGGGCTAGAG | CAGGTCTTCATCATGCCTTG |
| 24 | LC9D9 | 202452_at:ZER1 | CCTGGGGAGCAGCGCTAACC | CTGGAGGCAGCCTTTGGGTG |
| 25 | ZC12D12 | 202477_s_at:TUBGCP2 | ACACGGAGCGCCTGGAGCGC | CTGTCTGCAGAGAGGAGCCA |
| 26 | UUE8F8 | 202717_s_at:CDC16 | ACTCTGCTATTGGATATATC | CACAGTCTGATGGGCAACTT |
| 27 | VA5B5 | 202757_at:COBRA1 | ACGGGGCCAGCTGGACACAC | GGTGAGATTTTCTCGTATGT |
| 28 | EEE4F4 | 203118_at:PCSK7 | CCTGTCTTCCTCTGCAAGTG | CTCAGGGAAATGGCCTTCCC |
| 29 | AAA12B12 | 203154_s_at:PAK4 | TCATTTTATAACACTCTAGC | CCCTGCCCTTATTGGGGAC |
| 30 | LE8F8 | 203190_at:NDUFS8 | CCACGGAGACCCATGAGGAG | CTGCTGTACAACAAGGAGAA |
| 31 | ZC9D9 | 203201_at:PMM2 | GGAAGGATCCCGGGTCTCAG | CTAGAACACGGTGGAAGAGA |
| 32 | BE3F3 | 203517_at:MTX2 | TCTGTAGGAGAATTGAACAG | CACTATTTTGAAGATCGTGG |
| 33 | TE8F8 | 203530_s_at:STX4 | CATCACCGTCGTCCTCCTAG | CAGTCATCATTGGCGTCACA |
| 34 | FFC9D9 | 203572_s_at:TAF6 | CCTCTGGTCCTGGGAGTGTC | CAGAAGTACATCGTGGTCTC |
| 35 | MC4D4 | 204549_at:IKBKE | AGGGCAGTAGGTCAAACGAC | CTCATCACAGTCTTCCTTCC |
| 36 | UC11D11 | 204757_at:C2CD2L | GCCTCTGAGAATGTTGGCAG | CTCACAGAGAGCAGGGCCGG |
| 37 | FFE1F1 | 206050_s_at:RNH1 | GTCCTGTACGACATTTACTG | GTCTGAGGAGATGGAGGACC |
| 38 | AAA1B1 | 206075_s_at:CSNK2A1 | CTCCCAGGCTCCTTACCTTG | GTCTTTTCCCTGTTCATCTC |

TABLE 1-continued

Representative Type I (simple) Landmark Transcript/Probe-Pair Failures
(SEQ ID NOS 1-134, respectively, in order of appearance)

| ## | name | alternate name | left probe sequence | right probe sequence |
|---|---|---|---|---|
| 39 | SG10H10 | 207988_s_at:ARPC2 | TAAGAGGAGGAAGCGGCTGG | CAACTGAAGGCTGGAACACT |
| 40 | AE8F8 | 208093_s_at:NDEL1 | GCATGTTAATGACTCTGATG | GTGTCCTCCTCTGGGCAGCT |
| 41 | CG1H1 | 208152_s_at:DDX21 | GGAAGTTAAGGTTTCCTCAG | CCACCTGCCGAACAGTTTCT |
| 42 | GGG9H9 | 208174_x_at:ZRSR2 | TCGGGAGAGGCACAATTCAC | GAAGCAGAGGAAGAAATAGG |
| 43 | EEA12B12 | 208720_s_at:RBM39 | GATGGGATACCGAGATTAAG | GATGATGTGATTGAAGAATG |
| 44 | BA10B10 | 208887_at:EIF3G | GCTAAGGACAAGACCACTGG | CCAATCCAAGGGCTTCGCCT |
| 45 | EEA6B6 | 208996_s_at:POLR2C | CCAGTGCACCTGTAGGGAAC | CAACTAGACTTCTCTCCTGG |
| 46 | JE11F11 | 209044_x_at:SF3B4 | TCCCCCTCACTACCTTCCTC | CTGTACAACTTTGCTGACCT |
| 47 | SE12F12 | 209659_s_at:CDC16 | AAACGGGGCTTACGCCATTG | GAAACCTCAAGGAAAACTCC |
| 48 | IIA3B3 | 210947_s_at:MSH3 | TGGAATTGCCATTGCCTATG | CTACACTTGAGTATTTCATC |
| 49 | YYA10B10 | 211233_x_at:ESR1 | CTGCTGGCTACATCATCTCG | GTTCCGCATGATGAATCTGC |
| 50 | FFC1D1 | 212047_s_at:RNF167 | GTGACCTATTTGCACAGACC | GTCGTCTTCCCTCCAGTCTT |
| 51 | TTC2D2 | 212087_s_at:ERAL1 | CACAGGAGGCAGGCCATGAC | CTCATGGACATCTTCCTCTG |
| 52 | UUA10B10 | 212216_at:PREPL | CCTGAAATTCTGAAACACTG | CATTCAACTGGGAATTGGAA |
| 53 | OA4B4 | 212544_at:ZNHIT3 | AGGTCATGCAGGCCTTTACC | GGCATTGATGTGGCTCATGT |
| 54 | DDG6H6 | 212564_at:KCTD2 | ACGCAGGTGATGCCAGCCAG | GCCCAGGAGTGCCCAGCATC |
| 55 | IIE7F7 | 212822_at:HEG1 | GCGGATGAACTGACATGCTC | CTACCATGACCAGGCTCTGG |
| 56 | ZG12H12 | 212872_s_at:MED20 | AAGCCTCTGCAACAAGTCAG | GTGGTGGTCATGTTTCCCTT |
| 57 | NC5D5 | 212968_at:RFNG | ACCACAGAGATGTTTTCTCC | GCTCTGACTTGTGGCTCAGG |
| 58 | GGA5B5 | 214004_s_at:VGLL4 | GCCAAAGCTCTGGGTGACAC | GTGGCTCCAGATCAAAGCGG |
| 59 | AAC1D1 | 216525_x_at:PMS2L3 | TTTCTACCTGCCACGCGTCG | GTGAAGGTTGGGACTCGACT |
| 60 | FFA9B9 | 217832_at:SYNCRIP | TATATCACATACCCAATAGG | CACCACGATGAAGATCAGAG |
| 61 | BG1H1 | 217987_at:ASNSD1 | TTTTACGCCTTGCAGCTGTG | GAACTTGGTCTTACAGCCTC |
| 62 | UUC9D9 | 218114_at:GGA1 | TGGGGCACCTAGAGTTCTCG | GTGTGTCTCCTTCATTCATT |
| 63 | LE4F4 | 218386_x_at:USP16 | CAGCGACACACATGTGCAAG | CTGTGCCTACAACTAAAGTA |
| 64 | FFE3F3 | 218649_x_at:SDCCAG1 | GAAACTGAACAGTGAAGTGG | CTTGATTGCTTAAACTATTG |
| 65 | NG4H4 | 218725_at:SLC25A22 | CTGGCCATGTGATCGTGTTG | GTGACAGACCCTGATGTGCT |
| 66 | BBE10F10 | 218760_at:COQ6 | GGCTTTGGGGATATCTCCAG | CTTGGCCCATCACCTCAGTA |
| 67 | BE11F11 | 202209_at:LSM3 | GCCCCTCCACTGAGAGTTGG | CTGAAACAAAGAATTTGTCC |

TABLE 2

Representative Type II (complex) Landmark Transcript/Probe-Pair Failures
(SEQ ID NOS 135-170, respectively, in order of appearance)

| ## | name | alternate name | left probe sequence | right probe sequence |
|---|---|---|---|---|
| 1 | AA3B3 | 221049_s_at:POLL | ATTTTAAGCAGGAGCAGGTG | GCTGGTTTGAAGCCCCAGGT |
| 2 | AAG3H3 | 41160_at:MBD3 | GCTCCCTGTCAGAGTCAAAG | CACAAATCCTCAGGACGGGC |
| 3 | AC6D6 | 218912_at:GCC1 | TTTCTGCCCAGTGGGTCTTG | GCATAAGTAGATTAATCCTG |
| 4 | AE7F7 | 221560_at:MARK4 | GAGTTAAAGAAGAGGCGTGG | GAATCCAGGCAGTGGTTTTT |

TABLE 2-continued

Representative Type II (complex) Landmark Transcript/Probe-Pair Failures
(SEQ ID NOS 135-170, respectively, in order of appearance)

| ## | name | alternate name | left probe sequence | right probe sequence |
|---|---|---|---|---|
| 5 | AG4H4 | 219445_at:GLTSCR1 | AACAAGAAACTGGGGTCTTC | CTCTCCCCCGAACCTCTCCC |
| 6 | CA6B6 | 218936_s_at:CCDC59 | GCCTCTGAAGGAAGGTTGGC | CTGAAGAACTGAAAGAACCT |
| 7 | FFA4B4 | 221471_at:SERINC3 | CTTCCCTAGAAGAATGGTTG | CTGATATGGCTACTGCTTCT |
| 8 | GGA1B1 | 221490_at:UBAP1 | GGTTCTGCAATATCTCTGAG | GTGCAAAGAATGCACTTTTC |
| 9 | HHG1H1 | 222039_at:KIF18B | TGAAGATGTGGATGATAATG | GTGCCTTGATTTCCAAATGA |
| 10 | VG10H10 | 217762_s_at:RAB31 | GAACAATCAAAGTTGAGAAG | CCAACCATGCAAGCCAGCCG |
| 11 | NA5B5 | 221196_x_at:BRCC3 | GTTGCCAGGGATAGGGACTG | GAGGGGGTGTGGGGTATGTA |
| 12 | RRE10F10 | 222351_at:PPP2R1B | AGAGGACATGGGGAAGGGAC | CAGTGTATCAGTTGCGTGGA |
| 13 | SSE6F6 | 220079_s_at:USP48 | AGATGCGTTGGTCCATAAAG | GATTGTATCAAGTAGATGGG |
| 14 | TA5B5 | 221567_at:NOL3 | GTGAGACTAGAAGAGGGGAG | CAGAAAGGGACCTTGAGTAG |
| 15 | UUG11H11 | 221858_at:TBC1D12 | ATGGGTCATTCTAGTCTAAG | GACTACTAGTAGAACCCTCA |
| 16 | WC8D8 | 90610_at:LRCH4 | AAGACGCGCCTGGGCTCCGC | GCTCTCAGAGAAGCACGTGG |
| 17 | XE6F6 | 222199_s_at:BIN3 | ACGACTGAGCCCTGCTTCTG | CTGGGGCTGTGTACAGAGTG |
| 18 | YG1H1 | 221856_s_at:FAM63A | CTAGGATTGGTGGGTTTCTG | GTTCTCAACTCCCGGTCCCT |

TABLE 3

Representative Cluster Centroid Landmark Transcripts/Probe Pairs Validated
for LMF (SEQ ID NOS 171-2, 170, respectively, in order of appearance)

| ## | name | Affymetrix | gene symbol | left probe sequence | right probe sequence |
|---|---|---|---|---|---|
| 1 | QC7D7 | 209083_at | CORO1A | CCCTCCTCATCTCCCTCAAG | GATGGCTACGTACCCCCAAA |
| 2 | AAAG5H5 | 221223_x_at | CISH | TGTGTCTCACCCCCTCACAG | GACAGAGCTGTATCTGCATA |
| 3 | TE6F6 | 203458_at | SPR | GGAAAGAGTGATCTGGTGTC | GAATAGGAGGACCCATGTAG |
| 4 | MME12F12 | 203217_s_at | ST3GAL5 | AACTGTGAAGCCACCCTGGG | CTACAGAAACCACAGTCTTC |
| 5 | LLLC12D12 | 202862_at | FAH | TCCATGTTGGAACTGTCGTG | GAAGGGAACGAAGCCCATAG |
| 6 | IIC3D3 | 201393_s_at | IGF2R | AGAAGCAAACCGCCCTGCAG | CATCCCTCAGCCTGTACCGG |
| 7 | PPE8F8 | 203233_at | IL4R | CGGGCAATCCAGACAGCAGG | CATAAGGCACCAGTTACCCT |
| 8 | MMMA8B8 | 209531_at | GSTZ1 | TAGGGAGATGCGGGGAGCAG | GGTGGGCAGGAATACTGTTA |
| 9 | BBE6F6 | 218462_at | BXDC5 | ATCCTCAATTTATCGGAAGG | CAGGTTGCCACATTCCACAA |
| 10 | IIG7H7 | 213417_at | TBX2 | TAGACCGCGTGATAAAACTG | GGTTGAGGGATGCTGGAACC |
| 11 | NNA11B11 | 201795_at | LBR | TGGTGGCGTTTTCTGTACTG | GATTGCACCAAGGAAGCTTT |
| 12 | XG1H1 | 204752_x_at | PARP2 | TGGGAGTACAGTGCCATTAG | GACCAGCAAGTGACACAGGA |
| 13 | YA8B8 | 200713_s_at | MAPRE1 | CTTTGTTTGGCAGGATTCTG | CAAAATGTGTCTCACCCACT |
| 14 | MMME2F2 | 203138_at | HAT1 | AGCTGGAAGAGAGTTTTCAG | GAACTAGTGGAAGATTACCG |
| 15 | NG5H5 | 209515_s_at | RAB27A | ACTGTACTTGCTGGGTCTTG | CCAAGATCATTTATTCCGCT |
| 16 | SSG2H2 | 211605_s_at | RARA | CTCTCATCCAGGAAATGTTG | GAGAACTCAGAGGGCCTGGA |
| 17 | PG4H4 | 201078_at | TM9SF2 | TTACCAAAATATACAGTGTG | GTGAAGGTTGACTGAAGAAG |
| 18 | TE2F2 | 202401_s_at | SRF | GGTGATATTTTTATGTGCAG | CGACCCTTGGTGTTTCCCTT |
| 19 | ZZE5F5 | 203787_at | SSBP2 | GCTCCTGCCCCCTCCCTGAA | CTATTTTGTGCTGTGTATAT |

TABLE 3-continued

Representative Cluster Centroid Landmark Transcripts/Probe Pairs Validated for LMF (SEQ ID NOS 171-2, 170, respectively, in order of appearance)

| ## | name | Affymetrix | gene symbol | left probe sequence | right probe sequence |
|---|---|---|---|---|---|
| 20 | MMG1H1 | 200972_at | TSPAN3 | GACTGATGCCGAAATGTCAC | CAGGTCCTTTCAGTCTTCAC |
| 21 | XXG10H10 | 217766_s_at | TMEM50A | AAAAGCATGATTCCCACAAG | GACTAAGTATCAGTGATTTG |
| 22 | MC1D1 | 212166_at | XPO7 | GTGGATATTTATATATGTAC | CCTGCACTCATGAATGTATG |
| 23 | JJG3H3 | 204812_at | ZW10 | GGCCCTAGCTTTGGAACGAG | GAATTGGGAGATTCCAGGAG |
| 24 | ZZE7F7 | 218489_s_at | ALAD | CTGATGGCACATGGACTTGG | CAACAGGGTATCGGTGATGA |
| 25 | NA4B4 | 201739_at | SGK1 | TAGTATATTTAAACTTACAG | GCTTATTTGTAATGTAAACC |
| 26 | IIIA7B7 | 206770_s_at | SLC35A3 | CAAGACTGCTGAAAGCAATC | CAGTTGCTCCTGTGCTAGAT |
| 27 | QQC6D6 | 205774_at | F12 | GATTCCGCAGTGAGAGAGTG | GCTGGGGCATGGAAGGCAAG |
| 28 | NNE10F10 | 201611_s_at | ICMT | GCCTTAGGTAGTTGGGCTTG | CCCACCCTAGTTTGCTTTTG |
| 29 | VA3B3 | 209092_s_at | GLOD4 | ATGAGTGTGTGACGTTGCTG | CACGCCTGACTCTGTGCGAG |
| 30 | LLA1B1 | 219382_at | SERTAD3 | GAAAGCTGGGCCTGTCGAAG | GATGACAGGGATGTGCTGCC |
| 31 | NNE9F9 | 217872_at | PIH1D1 | AAGCCTCACCTGAACCTGTG | GCTGGAAGCCCCCGACCTCC |
| 32 | KKE12F12 | 207196_s_at | TNIP1 | CACAGTAGCCTTGCTGAAGC | CATCACAGATGGGAGAAGGC |
| 33 | NG12H12 | 202417_at | KEAP1 | TACATAGAAGCCACCGGATG | GCACTTCCCCACCGGATGGA |
| 34 | XG8H8 | 203630_s_at | COG5 | TTCACTAAATAAGCATGTAG | CTCAGTGGTTTCCAAATTTG |
| 35 | OOA7B7 | 219952_s_at | MCOLN1 | ATTCGACCTGACTGCCGTTG | GACCGTAGGCCCTGGACTGC |
| 36 | PPA9B9 | 203291_at | CNOT4 | ACGAGGGCACTCTGAGATAG | CACTGCTCTGGGGCCATCTG |
| 37 | HHHA5B5 | 217789_at | SNX6 | GCAGGTTTGCTTGACCTCTG | CCTCAGTTCTCGACTCTAAA |
| 38 | LLA7B7 | 203117_s_at | PAN2 | AGCAAGTAGAGTGTTGGTGG | CCCAAGCAAACCAGTGTTGC |
| 39 | QG3H3 | 202673_at | DPM1 | GATGGAGATGATTGTTCGGG | CAAGACAGTTGAATTATACT |
| 40 | MC11D11 | 203373_at | SOCS2 | AAAAACCAATGTAGGTATAG | GCATTCTACCCTTTGAAATA |
| 41 | VVA2B2 | 217719_at | EIF3L | TTATGGGGATTTCTTCATCC | GTCAGATCCACAAATTTGAG |
| 42 | FFFC6D6 | 210695_s_at | WWOX | CTGCTTGGTGTGTAGGTTCC | GTATCTCCCTGGAGAAGCAC |
| 43 | MMG8H8 | 201829_at | NET1 | GTGTAGTAAGTTGTAGAAGG | CTCGAGGGGACGTGGACTTA |
| 44 | JJJE10F10 | 203379_at | RPS6KA1 | CACACACCTCCGAGACAGTC | CAGTGTCACCTCTCTCAGAG |
| 45 | TTC4D4 | 204757_s_at | C2CD2L | AGACCAGCACCAGTGTCTGC | CTCTGAGAATGTTGGCAGCT |
| 46 | HHC11D11 | 203725_at | GADD45A | TCAACTACATGTTCTGGGGG | CCCGGAGATAGATGACTTTG |
| 47 | LLE12F12 | 202466_at | POLS | GGGTGTGCATTTTAAAACTC | GATTCATAGACACAGGTACC |
| 48 | IIE1F1 | 212124_at | ZMIZ1 | CATAAACACACCCACCAGTG | CAGCCTGAAGTAACTCCCAC |
| 49 | HHG8H8 | 200816_s_at | PAFAH1B1 | AAGCTGGATTTACAGGTCAC | GGCTGGACTGAATGGGCCTT |
| 50 | JJJA2B2 | 202635_s_at | POLR2K | AATCAGATGCAGAGAATGTG | GATACAGAATAATGTACAAG |
| 51 | JJJA10B10 | 203186_s_at | S100A4 | TGGACAGCAACAGGGACAAC | GAGGTGGACTTCCAAGAGTA |
| 52 | IIA5B5 | 207163_s_at | AKT1 | TAGCACTTGACCTTTTCGAC | GCTTAACCTTTCCGCTGTCG |
| 53 | RA9B9 | 218346_s_at | SESN1 | CAGCACCAAAGTTGTGGGAC | ATGTTGCTGTAGACTGCTGC |
| 54 | NA8B8 | 201896_s_at | PSRC1 | GAATTTATCTTCTTCCTTG | GCATTGGTTCACTGGACATT |
| 55 | MME3F3 | 203013_at | ECD | GACCAGGAACTAGCACACAC | CTGCATCAGCAAAAGTTTCA |
| 56 | IIIE12F12 | 207620_s_at | CASK | AAAAGCCTCTTTGTTATCGG | CCTTGTGTCAGCAGGTCATG |
| 57 | ZE4F4 | 201980_s_at | RSU1 | CAACACTTCATTCTCTCTTG | CCCTGTCTCTCAAATAAACC |

TABLE 3-continued

Representative Cluster Centroid Landmark Transcripts/Probe Pairs Validated for LMF (SEQ ID NOS 171-2, 170, respectively, in order of appearance)

| ## | name | Affymetrix | gene symbol | left probe sequence | right probe sequence |
|---|---|---|---|---|---|
| 58 | OE6F6 | 204825_at | MELK | GCTGCAAGGTATAATTGATG | GATTCTTCCATCCTGCCGGA |
| 59 | ZZA12B12 | 201170_s_at | BHLHE40 | ACTTGTTTTCCCGATGTGTC | CAGCCAGCTCCGCAGCAGCT |
| 60 | ZZE11F11 | 211715_s_at | BDH1 | CTGCGAATGCAGATCATGAC | CCACTTGCCTGGAGCCATCT |
| 61 | NNG3H3 | 208078_s_at | SIK1 | TTGGGGCAGCCAGGCCCTTG | CCTTCATTTTTACAGAGGTA |
| 62 | QC3D3 | 203338_at | PPP2R5E | CGTTCTATATCTCATCACAG | CGCCAGCCCTGTTTTTAGCC |
| 63 | MMMG11H11 | 217956_s_at | ENOPH1 | ACAGCAAGCAGTTGCCTTAC | CAGTGAAAAGGTGCACTGA |
| 64 | JJJA9B9 | 202095_s_at | BIRC5 | CCAACCTTCACATCTGTCAC | GTTCTCCACACGGGGGAGAG |
| 65 | MMME3F3 | 216836_s_at | ERBB2 | TCCCTGAAACCTAGTACTGC | CCCCCATGAGGAAGGAACAG |
| 66 | LLLE10F10 | 212694_s_at | PCCB | TCCACACGTGCCCGAATCTG | CTGTGACCTGGATGTCTTGG |
| 67 | ZZC6D6 | 204497_at | ADCY9 | TGAGAGCCCCACAGGCTCTG | CCACACCCGTGACTTCATCC |
| 68 | UUC1D1 | 221142_s_at | PECR | GTGTCCTCCATCCCCCAGTG | CCTTCACATCTTGAGGATAT |
| 69 | RE10F10 | 203246_s_at | TUSC4 | ATCTGCTGGAAGTGAGGCTG | GTAGTGACTGGATGGACACA |
| 70 | XE5F5 | 203071_at | SEMA3B | CAGGCCCTGGCTGAGGGCAG | CTGCGCGGGCTTATTTATTA |
| 71 | LLLC6D6 | 217784_at | YKT6 | AGGACCCTGGGGAGAGATGG | GGGCGGGGAAAATGGAGGTA |
| 72 | LE10F10 | 202784_s_at | NNT | CTATGCTGCAGTGGACAATC | CAATCTTCTACAAACCTAAC |
| 73 | NNNE6F6 | 200887_s_at | STAT1 | TGTAACTGCATTGAGAACTG | CATATGTTTCGCTGATATAT |
| 74 | WWC5D5 | 202540_s_at | HMGCR | GACTCTGAAAAACATTCCAG | GAAACCATGGCAGCATGGAG |
| 75 | MMG6H6 | 220643_s_at | FAIM | TGGTAAAAAATTGGAGACAG | CGGGTGAGTTTGTAGATGAT |
| 76 | ZG7H7 | 202446_s_at | PLSCR1 | AAATCAGGAGTGTGGTAGTG | GATTAGTGAAAGTCTCCTCA |
| 77 | HHHG9H9 | 219888_at | SPAG4 | GCTGGGCTTTTGAAGGCGAC | CAAGGCCAGGTGGTGATCCA |
| 78 | EEEE11F11 | 204653_at | TFAP2A | GTATTCTGTATTTTCACTGG | CCATATTGGAAGCAGTTCTA |
| 79 | MME5F5 | 217080_s_at | HOMER2 | AAACAAGCTTCTGGTGGGTG | CATTTTCTGGCCCGGAGTTG |
| 80 | NE9F9 | 212846_at | RRP1B | CTAAGTAAAATTGCCAAGTG | GACTTGGAAGTCCAGAAAGG |
| 81 | YYA9B9 | 203442_x_at | EML3 | GCCTTGACTCCCGCTGCCTG | CTGAGGGGCAATAAACCAGA |
| 82 | HHE2F2 | 202324_s_at | ACBD3 | AGCTCATAGGTGTTCATACT | GTTACATCCAGAACATTTGT |
| 83 | NNNA5B5 | 214473_x_at | PMS2L3 | CATCAGAATTACTTTGAAGG | CTACTATTAATATGCAGACT |
| 84 | PA1B1 | 203008_x_at | TXNDC9 | TGATGTTGAATCAACTGATG | CCAGCAGAAAGCTATTTTGA |
| 85 | KKKC9D9 | 209526_s_at | HDGFRP3 | TTTCCTCTCTGTGACAGAAC | CCAGGAATTAATTCCTAAAT |
| 86 | PPG5H5 | 202794_at | INPP1 | GCAGAGACGCATACCTAGAG | GAACTCTAACCCCGGTGTAC |
| 87 | OA6B6 | 202990_at | PYGL | CAAAGGCCTGGAACACAATG | GTACTCAAAAACATAGCTGC |
| 88 | QQC5D5 | 205452_at | PIGB | CACTTCCCATGAGATTTCTC | CAGTGCCCGCCAGACCTGAC |
| 89 | UG11H11 | 204458_at | PLA2G15 | TTTTCTCTGTTGCATACATG | CCTGGCATCTGTCTCCCCTT |
| 90 | QE4F4 | 207842_s_at | CASC3 | GGTGGTTGTGCCTTTTGTAG | GCTGTTCCCTTTGCCTTAAA |
| 91 | QQA9B9 | 211071_s_at | MLLT11 | CTTCACACCTACTCACTTTA | CAACTTTGCTCCTAACTGTG |
| 92 | PC12D12 | 206846_s_at | HDAC6 | CCCATCCTGAATATCCTTTG | CAACTCCCCAAGAGTGCTTA |
| 93 | SSC3D3 | 201498_at | USP7 | TGCTGCCTTGGCAGACTTAC | GATCTCAACAGTTCATACGA |
| 94 | IIIG4H4 | 213851_at | TMEM110 | GACCACCGAGTGGCAAGGTG | GAAGGAAGCACAGGCACACA |
| 95 | RRG5H5 | 219492_at | CHIC2 | AGTATGTTGTCTTTCCAATG | GTGCCTTGCTTGGTGCTCTC |

TABLE 3-continued

Representative Cluster Centroid Landmark Transcripts/Probe Pairs Validated for LMF (SEQ ID NOS 171-2, 170, respectively, in order of appearance)

| ## | name | Affymetrix | gene symbol | left probe sequence | right probe sequence |
|---|---|---|---|---|---|
| 96 | PPG4H4 | 202703_at | DUSP11 | ATTCTACCTGGAGACCAGAG | CTGGCCTGAAAATTACTGGT |
| 97 | ZA4B4 | 218145_at | TRIB3 | TCTAACTCAAGACTGTTCTG | GAATGAGGGTCCAGGCCTGT |
| 98 | MC7D7 | 212255_s_at | ATP2C1 | CCAGGAGTGCCATATTTCAG | CTACTGTATTTCCTTTTTCT |
| 99 | VE9F9 | 200083_at | USP22 | CACCACTGCAACATATAGAC | CTGAGTGCTATTGTATTTTG |
| 100 | SG7H7 | 202630_at | APPBP2 | CTTCATTGTGTCAGGATGAC | CTTTCATATCATTCTCACCA |
| 101 | RC2D2 | 201774_s_at | NCAPD2 | CTGTGCAGGGTATCCTGTAG | GGTGACCTGGAATTCGAATT |
| 102 | AAA7B7 | 203279_at | EDEM1 | TCACAGGGCTCAGGGTTATG | CTCCCGCTTGAATCTGGACG |
| 103 | RRA12B12 | 204225_at | HDAC4 | GGCTAAGATTTCACTTTAAG | CAGTCGTGAACTGTGCGAGC |
| 104 | UE5F5 | 201671_x_at | USP14 | TCAGTCAGATTCTTTCCTTG | GCTCAGTTGTGTTTGTATTT |
| 105 | NNNA8B8 | 218046_s_at | MRPS16 | CACCAATCGGCCGTTCTACC | GCATTGTGGCTGCTCACAAC |
| 106 | HHC8D8 | 209263_x_at | TSPAN4 | CACCTACATTCCATAGTGGG | CCCGTGGGGCTCCTGGTGCA |
| 107 | QE3F3 | 200621_at | CSRP1 | AGGCATGGGCTGTACCCAAG | CTGATTTCTCATCTGGTCAA |
| 108 | KKA2B2 | 200766_at | CTSD | GGGGTAGAGCTGATCCAGAG | CACAGATCTGTTTCGTGCAT |
| 109 | YA5B5 | 201985_at | KIAA0196 | GTGCCCTTCTGTTCCTGGAG | GATTATGTTCGGTACACAAA |
| 110 | HHG5H5 | 203154_s_at | PAK4 | CCTGCAGCAAATGACTACTG | CACCTGGACAGCCTCCTCTT |
| 111 | PPG1H1 | 202284_s_at | CDKN1A | CAGACATTTTAAGATGGTGG | CAGTAGAGGCTATGGACAGG |
| 112 | EEEA11B11 | 218584_at | TCTN1 | TGCAGAGGCAGGCTTCAGAG | CTCCACCAGCCATCAATGCC |
| 113 | VE10F10 | 212943_at | KIAA0528 | CCCCCAGGACAACAAACTGC | CCTTAAGAGTCATTTCCTTG |
| 114 | ZZA5B5 | 204656_at | SHB | TCCAAAGAGATGCCTTCCAG | GATGAACAAAGGCAGACCAG |
| 115 | EEEG6H6 | 205573_s_at | SNX7 | TGCTAATAATGCCCTGAAAG | CAGATTGGGAGAGATGGAAA |
| 116 | OOE7F7 | 200670_at | XBP1 | AGTTTGCTTCTGTAAGCAAC | GGGAACACCTGCTGAGGGGG |
| 117 | YYC10D10 | 201328_at | ETS2 | TCTGTTTACTAGCTGCGTGG | CCTTGGACGGGTGGCTGACA |
| 118 | QQE9F9 | 212765_at | CAMSAP1L1 | GTTTCATGGACACTGTTGAG | CAATGTACAGTGTATGGTGT |
| 119 | IIE12F12 | 202986_at | ARNT2 | GTGCAGGCACATTTCCAAGC | GTAGGTGTCCCTGGCTTTTG |
| 120 | XA8B8 | 201997_s_at | SPEN | AGACTGGCTAACCCCTCTTC | CTATTACCTTGATCTCTTCC |
| 121 | VA8B8 | 203218_at | MAPK9 | CATGTGACCACAAATGCTTG | CTTGGACTTGCCCATCTAGC |
| 122 | UUA3B3 | 219281_at | MSRA | TTATCTGTGCTCTCTGCCCG | CCAGTGCCTTACAATTTGCA |
| 123 | MME8F8 | 201649_at | UBE2L6 | CTTGCCATCCTGTTAGATTG | CCAGTTCCTGGGACCAGGCC |
| 124 | MA4B4 | 202282_at | HSD17B10 | TCAATGGAGAGGTCATCCGG | CTGGATGGGCCATTCGTAT |
| 125 | UUG6H6 | 218794_s_at | TXNL4B | CTTGCTTTTGGCTCATACAG | GAGAGAGGGAAGGCTGCCAG |
| 126 | AAAE9F9 | 202866_at | DNAJB12 | AGATTATAAGAACTGATGTG | GCCAGAGTGCCTACCCACTG |
| 127 | LC7D7 | 203050_at | TP53BP1 | TGTCACAAGAGTGGGTGATC | CAGTGCCTCATTGTTGGGGA |
| 128 | IIC12D12 | 200045_at | ABCF1 | GGTGGTGCTGTTCTTTTCTG | GTGGATTTAATGCTGACTCA |
| 129 | HHC10D10 | 218523_at | LHPP | GGCACACAGGGTACTTTCTG | GACCCACTGCTGGACAGACT |
| 130 | AC11D11 | 202535_at | FADD | GAGTCTCCTCTCTGAGACTG | CTAAGTAGGGGCAGTGATGG |
| 131 | PE9F9 | 202331_at | BCKDHA | TCAGGGGACAGCATCTGCAG | CAGTTGCTGAGGCTCCGTCA |
| 132 | IIC4D4 | 204087_s_at | SLC5A6 | AGAGCAAGCACGTTTTCCAC | CTCACTGTCTCCATCCTCCA |
| 133 | HHE7F7 | 201555_at | MCM3 | TTGCATCTTCATTGCAAAAG | CACTGGCTCATCCGCCCTAC |

TABLE 3-continued

Representative Cluster Centroid Landmark Transcripts/Probe Pairs Validated for LMF (SEQ ID NOS 171-2, 170, respectively, in order of appearance)

| ## | name | Affymetrix | gene symbol | left probe sequence | right probe sequence |
|---|---|---|---|---|---|
| 134 | OOG4H4 | 212557_at | ZNF451 | AGGAGGTAGTCACTGAGCTG | GACCTTAAACACATCTGCAG |
| 135 | QQC2D2 | 204809_at | CLPX | GCCCCGCCAAGCAGATGCTG | CAAACAGCTAAACTGTCATA |
| 136 | PPC9D9 | 203301_s_at | DMTF1 | CGAGAGAATAGTTTGTCATC | CACTTAGTGTGTTAGCTGGT |
| 137 | PPE2F2 | 202361_at | SEC24C | CCTGCTGGGACACCGCTTGG | GCTTTGGTATTGACTGAGTG |
| 138 | XG12H12 | 202716_at | PTPN1 | CGAGGTGTCACCCTGCAGAG | CTATGGTGAGGTGTGGATAA |
| 139 | PPE12F12 | 204042_at | WASF3 | GCACAAGGCAAGTGAGTTTG | CACTGTCAGCCCCAGACCGT |
| 140 | HHE11F11 | 201675_at | AKAP1 | AGACATGAACTGACTAATTG | GTATCCACTACTTGTACAGC |
| 141 | BBBE11F11 | 217989_at | HSD17B11 | TCCAATGCCAAACATTTCTG | CACAGGGAAGCTAGAGGTGG |
| 142 | SSA8B8 | 202260_s_at | STXBP1 | GTCTCCCTCCCAACTTATAC | GACCTGATTTCCTTAGGACG |
| 143 | AAE5F5 | 201225_s_at | SRRM1 | GAAATGAATCAGGATTCGAG | CTCTAGGATGAGACAGAAAA |
| 144 | IIE11F11 | 202624_s_at | CABIN1 | GTAAATCTGCCCACACCCAG | CTGGCCATATCCACCCCTCG |
| 145 | UC2D2 | 202705_at | CCNB2 | TTGTGCCCTTTTTCTTATTG | GTTTAGAACTCTTGATTTTG |
| 146 | MMA11B11 | 202798_at | SEC24B | TTGAACTCTGGCAAGAGATG | CCAAAAGGCATTGGTACCGT |
| 147 | IIG5H5 | 200053_at | SPAG7 | TGCTATTAGAGCCCATCCTG | GAGCCCCACCTCTGAACCAC |
| 148 | HHG2H2 | 202945_at | FPGS | CACACCTGCCTGCGTTCTCC | CCATGAACTTACATACTAGG |
| 149 | OOE9F9 | 201292_at | TOP2A | AATCTCCCAAAGAGAGAAAC | CAATTTCTAAGAGGACTGGA |
| 150 | NC9D9 | 209760_at | KIAA0922 | GCCCCATCAACCCCACCACG | GAACATTCGACCCACATGGA |
| 151 | XA4B4 | 204755_x_at | HLF | TCGTCAATCCATCAGCAATG | CTTCTCTCATAGTGTCATAG |
| 152 | AAG6H6 | 209147_s_at | PPAP2A | ACGCCCCACACTGCAATTTG | GTCTTGTTGCCGTATCCATT |
| 153 | QQE4F4 | 205190_at | PLS1 | TCCATCTTCCACTGTTAGTG | CCAGTGAGCAATACTGTTGT |
| 154 | XC4D4 | 201391_at | TRAP1 | CGAGAACGCCATGATTGCTG | CTGGACTTGTTGACGACCCT |
| 155 | UUG2H2 | 218807_at | VAV3 | TGGGCCTGGGGGTTTCCTAG | CAGAGGATATTGGAGCCCCT |
| 156 | TTG9H9 | 209806_at | HIST1H2BK | GGGGTTGGGGTAATATTCTG | TGGTCCTCAGCCCTGTACCT |
| 157 | PPG10H10 | 203755_at | BUB1B | GCTTGCAGCAGAAATGAATG | GGGTTTTTGACACTACATTC |
| 158 | MA9B9 | 203465_at | MRPL19 | CCAGAATGGTCTTTAATGAG | CATGGAACCTGAGCAAAGGG |
| 159 | VA9B9 | 202679_at | NPC1 | CCTTTTAGGAGTAAGCCATC | CCACAAGTTCTATACCATAT |
| 160 | RRE8F8 | 218051_s_at | NT5DC2 | CTTCTCTGACCTCTACATGG | CCTCCCTCAGCTGCCTGCTC |
| 161 | JJA4B4 | 204828_at | RAD9A | GCCTTGGACCCGAGTGTGTG | GCTAGGGTTGCCCTGGCTGG |
| 162 | PPA12B12 | 203965_at | USP20 | ATCAGGATCAAAGCAGACGG | GGCGTGGGTGGGAAGGGGC |
| 163 | JJA9B9 | 209507_at | RPA3 | TGGAATTGTGGAAGTGGTTG | GAAGAGTAACCGCCAAGGCC |
| 164 | XE1F1 | 203068_at | KLHL21 | CAGTTCACCCCAGAGGGTCG | GGCAGGTTGACATATTTATT |
| 165 | NNNG3H3 | 201339_s_at | SCP2 | TCAGCTTCAGCCAGGCAACG | CTAAGCTCTGAAGAACTCCC |
| 166 | PPG2H2 | 202369_s_at | TRAM2 | TGAAGGATGAACTAAGGCTG | CTGGTGCCCTGAGCAACTGA |
| 167 | UUC11D11 | 208716_s_at | TMCO1 | AAGGCACTGTGTATGCCCTG | CAAGTTGGCTGTCTATGAGC |
| 168 | CG4H4 | 218271_s_at | PARL | GGGATTGGACAGTAGTGGTG | CATCTGGTCCTTGCCGCCTG |
| 169 | KKC6D6 | 202188_at | NUP93 | AGGTCCTCATGAATTAAGTG | CCATGCTTTGTGGGAGTCTG |
| 170 | BBBA5B5 | 221245_s_at | FZD5 | GAGCCAAATGAGGCACATAC | CGAGTCAGTAGTTGAAGTCC |
| 171 | RRE5F5 | 219485_s_at | PSMD10 | TGTGAGTCTTCAGCACCCTC | CCATGTACCTTATATCCCTC |

TABLE 3-continued

Representative Cluster Centroid Landmark Transcripts/Probe Pairs Validated for LMF (SEQ ID NOS 171-2, 170, respectively, in order of appearance)

| ## | name | Affymetrix | gene symbol | left probe sequence | right probe sequence |
|---|---|---|---|---|---|
| 172 | LA6B6 | 201263_at | TARS | CAGTGGCACTGTTAATATCC | GCACAAGAGACAATAAGGTC |
| 173 | NNC5D5 | 213196_at | ZNF629 | AAACTGCTATGGACATGGAG | GTCAGATGGGAACTTGGAAC |
| 174 | TC8D8 | 201932_at | LRRC41 | GCAAACAGGCATTCTCACAG | CTGGGTTTATAGTCTTTGGG |
| 175 | SG8H8 | 204758_s_at | TRIM44 | GTCCTGACTCACTAAAGATG | CCAGGATATTGGGGCTGAGG |
| 176 | IIIG8H8 | 213669_at | FCHO1 | CGCATGTCGCTGGTGAAGAG | GAGGTTTGCCACAGGGATGT |
| 177 | NNA7B7 | 219581_at | TSEN2 | CACTTTCATACGCAGGCATC | TCTTGTTACCTACATCTAAG |
| 178 | LE7F7 | 201704_at | ENTPD6 | TTCTGGACACCAACTGTGTC | CTGTGAATGTATCGCTACTG |
| 179 | ZA7B7 | 205225_at | ESR1 | CCCTTTGCATTCACAGAGAG | GTCATTGGTTATAGAGACTT |
| 180 | CCCG4H4 | 210582_s_at | LIMK2 | AAGCTCGATGGGTTCTGGAG | GACAGTGTGGCTTGTCACAG |
| 181 | NNE11F11 | 202382_s_at | GNPDA1 | GTGCCTGTTTGAAGCTACTG | CTGCCTCCATTTCTGGGAAA |
| 182 | PPE6F6 | 202809_s_at | INTS3 | TATGACGTGGTCAGGGTGTC | CATTCCTAATCATGGGGCAG |
| 183 | SSG9H9 | 201833_at | HDAC2 | ACCAAATCAGAACAGCTCAG | CAACCCCTGAATTTGACAGT |
| 184 | BBBE9F9 | 200697_at | HK1 | TCCGTGGAACCAGTCCTAGC | CGCGTGTGACAGTCTTGCAT |
| 185 | NA7B7 | 208741_at | SAP18 | GGAATTGGTGTCCCTGTTAG | CAATGGCAGAGACCAGCCTG |
| 186 | UC6D6 | 202117_at | ARHGAP1 | CTGGTCTGTACCCCAGGGAG | CGGGTGCTTGTACTGTGTGA |
| 187 | TE9F9 | 202651_at | LPGAT1 | GCTGGTCACACGTGGATCTG | GTTTATGAATGCATTTGGGA |
| 188 | LE3F3 | 203073_at | COG2 | TGGGCTTTCTAAAGAGGCTG | CGGGAAGCCATCCTCCACTC |
| 189 | IIIC2D2 | 218108_at | UBR7 | GCAGCACAATAGTACCGATC | AGTTAACTCAGCGCTGAAGG |
| 190 | HHHC9D9 | 201855_s_at | ATMIN | GCATGTAATAATACAAGAAC | TGTTTCCCCCTCAAAACCTG |
| 191 | PPE5F5 | 202763_at | CASP3 | ACTGCACCAAGTCTCACTGG | CTGTCAGTATGACATTTCAC |
| 192 | OOA3B3 | 206109_at | FUT1 | TGAGATAAAACGATCTAAAG | GTAGGCAGACCCTGGACCCA |
| 193 | VE3F3 | 202891_at | NIT1 | GAACCTGACTCTCTTGATG | GAACACAGATGGGCTGCTTG |
| 194 | RRC12D12 | 204313_s_at | CREB1 | TGTCCTTGGTTCTTAAAAGC | ATTCTGTACTAATACAGCTC |
| 195 | QA9B9 | 209029_at | COPS7A | TTTCCTCTCTCTGGCCCTTG | GGTCCTGGGAATGCTGCTGC |
| 196 | PG7H7 | 209304_x_at | GADD45B | GGGAGCTGGGGCTGAAGTTG | CTCTGTACCCATGAACTCCC |
| 197 | PPC4D4 | 202691_at | SNRPD1 | CTAGAATTGATTCTCCTTTC | CTGAGTTTTACTCCACGGAG |
| 198 | RRA2B2 | 218375_at | NUDT9 | GCCATGCGTTGTAGCTGATG | GTCTCCGTGTAAGCCAAAGG |
| 199 | PPC8D8 | 203080_s_at | BAZ2B | AACCACTGTGTTTATCTAC | TGTGTGTTGTGGTGGCCTGT |
| 200 | BBBC10D10 | 221750_at | HMGCS1 | GGGCAGGCCTGCAAATACTG | GCACAGAGCATTAATCATAC |
| 201 | QQA11B11 | 213119_at | SLC36A1 | GACATAAATGGTGCTGGTAG | GAGGTTATCAGAGTAAGGAA |
| 202 | EEEC12D12 | 202011_at | TJP1 | GGGGCAGTGGTGGTTTTCTG | TTCTTTCTGGCTATGCATTT |
| 203 | QQC7D7 | 208190_s_at | LSR | TGGGCGGCTACTGGAGGAGG | CTGTGAGGAAGAAGGGGTCG |
| 204 | UC10D10 | 202468_s_at | CTNNAL1 | ATGACAAGCTTATGCTTCTC | CTGGAAATAAACAAGCTAAT |
| 205 | QA7B7 | 218206_x_at | SCAND1 | TCGGGCCCGGGGCCTGAGC | CTGGGACCCCACCCCGTGTT |
| 206 | EEEG10H10 | 204158_s_at | TCIRG1 | TGCTGGTCCCCATCTTTGCC | GCCTTTGCCGTGATGACCGT |
| 207 | XG2H2 | 202128_at | KIAA0317 | TTAGCGTCTTTGAAGGAGAC | CAGACATGAGTGAATACCTA |
| 208 | RG3H3 | 203105_s_at | DNM1L | TTATGAACTCCTGTGTATTG | CAATGGTATGAATCTGCTCA |
| 209 | QQE5F5 | 205633_s_at | ALAS1 | TCCTATTTCTCAGGCTTGAG | CAAGTTGGTATCTGCTCAGG |

TABLE 3-continued

Representative Cluster Centroid Landmark Transcripts/Probe Pairs Validated
for LMF (SEQ ID NOS 171-2, 170, respectively, in order of appearance)

| ## | name | Affymetrix | gene symbol | left probe sequence | right probe sequence |
|---|---|---|---|---|---|
| 210 | NG7H7 | 203228_at | PAFAH1B3 | TGGCTTTGTGCACTCAGATG | GCACCATCAGCCATCATGAC |
| 211 | RC1D1 | 208820_at | PTK2 | ACCAGAGCACCTCCAAACTG | CATTGAGGAGAAGTTCCAGA |
| 212 | ZZG8H8 | 204765_at | ARHGEF5 | GCTTAAACATTCTCCGCCTC | CAGGGTGCAGATTCAGAGCT |
| 213 | IIE9F9 | 201719_s_at | EPB41L2 | TGGTTACAAGAAAGTTATAC | CATTTAAAGCTGGCACCAGA |
| 214 | JJG10H10 | 212591_at | RBM34 | AGGATTGTGAGAGACAAAAT | GACAGGCATCGGCAAAGGGT |
| 215 | OE11F11 | 202633_at | TOPBP1 | TCTTTTAACAGGAGCCTGAG | CACAAGGTTTAATGAGGAAG |
| 216 | AAAG1H1 | 209213_at | CBR1 | TGACATGGCGGGACCCAAGG | CCACCAAGAGCCCAGAAGAA |
| 217 | EEEE6F6 | 208879_x_at | PRPF6 | GCCTGCAACATTCGGCCGTG | GTTACGATGAGTTTACCCCT |
| 218 | NE3F3 | 206398_s_at | CD19 | TGACTCTGAAATCTGAAGAC | CTCGAGCAGATGATGCCAAC |
| 219 | TTA1B1 | 209095_at | DLD | CTTTTGTAGAAGTCACATTC | CTGAACAGGATATTCTCACA |
| 220 | HHA9B9 | 201207_at | TNFAIP1 | AGTCTTTTTTGCCGAGAAAG | CACAGTAGTCTGGGACTGGG |
| 221 | IIC9D9 | 201462_at | SCRN1 | CAGTCCCAGGTCCCAGCTCC | CCTCTTATGGTTTCTGTCAT |
| 222 | FFFA3B3 | 218245_at | TSKU | GCAGTGAGCTCTGTCTTCCC | CCACCTGCCTAGCCCATCAT |
| 223 | PC4D4 | 212910_at | THAP11 | TTTTCCTTCCCAGGTGCAGC | CTGTGATTCTGATGGGGACT |
| 224 | IIG2H2 | 219968_at | ZNF589 | AGGAATGGCTGGTCCAGAGG | CTTTTGTCCACTCCCTCTCA |
| 225 | MMMC11D11 | 221531_at | WDR61 | ATGCCTCCTGGGTGCTGAAC | GTTGCATTCTGTCCTGATGA |
| 226 | NNNG7H7 | 205172_x_at | CLTB | GTCGGGGTGGAGACTCGCAG | CAGCTGCTACCCACAGCCTA |
| 227 | WE7F7 | 202788_at | MAPKAPK3 | GGTATACTTGTGTGAAAGTG | GCTGGTTGGGAGCAGAGCTA |
| 228 | ZG4H4 | 212054_x_at | TBC1D9B | GTGTTAGCCCCCACATGGGG | CTGCTCTTGCTTCTACTAAA |
| 229 | SSG4H4 | 208510_s_at | PPARG | TGCTCCAGAAAATGACAGAC | CTCAGACAGATTGTCACGGA |
| 230 | QG10H10 | 203574_at | NFIL3 | GAGACTTATAGCCACACAAC | CAATCTCTGCTTCAGACTCT |
| 231 | YE1F1 | 201032_at | BLCAP | CGCTTCAGTAACAAGTGTTG | GCAAACGAGACTTTCTCCTG |
| 232 | TE12F12 | 201889_at | FAM3C | ATATGCTAAATCACATTCAG | CATGTGTATTTTGACATTTA |
| 233 | MMG11H11 | 202946_s_at | BTBD3 | GGCAGTCTTTGTCGTTGTTC | ATTCTGGGGATAAAGGGGAA |
| 234 | UUG10H10 | 201380_at | CRTAP | TGCATCTCCAAAATTACAAC | GGTTGGCCGATCCCATTTGA |
| 235 | FFFA8B8 | 219711_at | ZNF586 | CCTGCCAGTCATGAATCTCA | GACAGCCTGCCACCTATTGC |
| 236 | QC8D8 | 203646_at | FDX1 | GAAGGCAGAGATCTAACCTG | GCTTGTTTAGGGCCATACCA |
| 237 | HHHA6B6 | 204985_s_at | TRAPPC6A | AGGTGGGGGTGTCAGAGGAG | GCAAAGGGGTCCCAGCTGCG |
| 238 | SA3B3 | 202680_at | GTF2E2 | TTTTTCTCCACTTCTAAATG | GTTCCTGGTTCCTTTCTTCC |
| 239 | EEEA12B12 | 213135_at | TIAM1 | TATCATCTCCGGTTCGATCG | CGTCCAGATGGAAAACGGAA |
| 240 | VG7H7 | 201761_at | MTHFD2 | AAGTACGCAACTTACTTTTC | CACCAAAGAACTGTCAGCAG |
| 241 | TTG3H3 | 217825_s_at | UBE2J1 | CCTTGATTCAGTGCTCAGTG | GTCTCCTAGTAAGAAGTCAC |
| 242 | OOC8D8 | 201158_at | NMT1 | GGTGCCATGTCTGGGAACAG | GGACGGGGAGCTTCACCTT |
| 243 | PPA7B7 | 202813_at | TARBP1 | TTCCTCAACAGGGCATTATC | CGCTCCCTGAATGTCCATGT |
| 244 | JJJG4H4 | 206066_s_at | RAD51C | CACTGGAACTTCTTGAGCAG | GAGCATACCCAGGGCTTCAT |
| 245 | PA5B5 | 217934_x_at | STUB1 | TGTTTCCCCTCTCAGCATCG | CTTTTGCTGGGCCGTGATCG |
| 246 | MMA3B3 | 202394_s_at | ABCF3 | TATTCCCAAATGTCTCTATC | CTTTTGACTGGAGCATCTTC |
| 247 | TA6B6 | 208647_at | FDFT1 | CATTCAGTGCCACGGTTTAG | GTGAAGTCGCTGCATATGTG |

TABLE 3-continued

Representative Cluster Centroid Landmark Transcripts/Probe Pairs Validated for LMF (SEQ ID NOS 171-2, 170, respectively, in order of appearance)

| ## | name | Affymetrix | gene symbol | left probe sequence | right probe sequence |
|---|---|---|---|---|---|
| 248 | LE1F1 | 202733_at | P4HA2 | TGTCTGGAGCAGAGGGAGAC | CATACTAGGGCGACTCCTGT |
| 249 | JJJG6H6 | 201589_at | SMC1A | CAATCCATCTTCTGTAATTG | CTGTATAGATTGTCATCATA |
| 250 | IIIC4D4 | 215000_s_at | FEZ2 | GGTGGTGATGGATTTTGTAG | CTTGCTGCTTGTTTCACCAC |
| 251 | LC11D11 | 203963_at | CA12 | CACAGACAGTTTCTGACAGG | CGCAACTCCTCCATTTTCCT |
| 252 | YC3D3 | 206662_at | GLRX | ATGGATCAGAGGCACAAGTG | CAGAGGCTGTGGTCATGCGG |
| 253 | BBBG2H2 | 202942_at | ETFB | TGCTGGGCAAACAGGCCATC | GATGATGACTGTAACCAGAC |
| 254 | XC6D6 | 201234_at | ILK | AGAAGATGCAGGACAAGTAG | GACTGGAAGGTCCTTGCCTG |
| 255 | UUG9H9 | 212206_s_at | H2AFV | CCCTGTTTCCTGTTGATATG | GTGATAGTTGGAGAGTCAAA |
| 256 | RRA1B1 | 217906_at | KLHDC2 | TGATCACCTTGCATGGACAG | CAATCCTGTAAACATCACAG |
| 257 | OE12F12 | 201494_at | PRCP | ATCAGTGGCCCTCATAACTG | GAGTAGAGTTCCTGGTTGCT |
| 258 | RA1B1 | 204054_at | PTEN | CTACCCCTTTGCACTTGTGG | CAACAGATAAGTTTGCAGTT |
| 259 | RRC9D9 | 218856_at | TNFRSF21 | GGTCCAATCTGCTCTCAAGG | CCTTGGTCCTGGTGGGATTC |
| 260 | LLLE7F7 | 211747_s_at | LSM5 | AGCTAAGTTTCCCGTTAAAG | GGAAGTGCTTTGAAGATGTG |
| 261 | RRE12F12 | 206364_at | KIF14 | TTGCTGGCACAGTAGTTTAC | CCTGTTATCTGTGTTTCATA |
| 262 | JJC4D4 | 204849_at | TCFL5 | TTGTCATGACTCTGAGTCAC | GTGCTGCTGTATTGCAACGT |
| 263 | PPA1B1 | 202153_s_at | NUP62 | ACAATGAAGCCCAGTGTAAC | GTCAGTCCACAGAAATAGCC |
| 264 | HHE5F5 | 218014_at | NUP85 | ACGTCTCGGATTGCCCCTCG | GTCTTTCTGGATGACTCTGC |
| 265 | KKG10H10 | 205088_at | MAMLD1 | GCACCCTCGTGGGGTTAAGG | CGAGCTGTTCCTGGTTTAAA |
| 266 | JJC6D6 | 205340_at | ZBTB24 | TGAAACACCTCGTTTTGAAG | GTGAATCTTTGGTTTTCTCC |
| 267 | KKE3F3 | 203130_s_at | KIF5C | TCCATGTAACAAAAGATCTG | GAAGTCACCCTCCTCTGGCC |
| 268 | YC5D5 | 208309_s_at | MALT1 | CTGTCATTGCAGCCGGACTC | CAGATGCATTTATTTCAAGT |
| 269 | TTE4F4 | 221567_at | NOL3 | ACCCCACGCAAGTTCCTGAG | CTGAACATGGAGCAAGGGGA |
| 270 | NE1F1 | 219650_at | ERCC6L | ATCTCAAAAAGCAACTTCTG | CCCTGCAACGCCCCCCACTC |
| 271 | KKC10D10 | 201121_s_at | PGRMC1 | CTCTCCTAAGAGCCTTCATG | CACACCCCTGAACCACGAGG |
| 272 | SSA1B1 | 203201_at | PMM2 | GTTCCCTCCAAACCTCCCAG | CCACTCGGGCTTGTAACTGT |
| 273 | LLE4F4 | 218170_at | ISOC1 | GGATAGAAGGGTTTGCAATG | CCATATTATTGGTGGAGGGC |
| 274 | IIIC5D5 | 203288_at | KIAA0355 | TGTGTGAAGCCGTTTGTGTG | GTCTCCATGTAGGTGCTGTG |
| 275 | BBBA3B3 | 217838_s_at | EVL | TAAGGGGCCGGCCTCGCTGC | GCTGATTCGTCGAGCCCATC |
| 276 | HHG4H4 | 213292_s_at | SNX13 | CTCAAATACTGTTGTGTCTG | CACCAGTCTTTTAGTGTCTC |
| 277 | UC1D1 | 202602_s_at | HTATSF1 | GGGCCCCTATCCACTGGCAG | CAGCTTTATTCTCAGTAGCG |
| 278 | ZC4D4 | 202349_at | TOR1A | CACCTTAGCAACAATGGGAG | CTGTGGGAGTGATTTTGGCC |
| 279 | MMME10F10 | 201560_at | CLIC4 | CCAGAGTTGCATGTAGATAG | CATTTATTTCTGTGCCCTTA |
| 280 | ZZA4B4 | 207749_s_at | PPP2R3A | TTTGCCTCAAACCTCTTACG | GAGCTTCTCCTCAGAAGTGG |
| 281 | MMC12D12 | 203188_at | B3GNT1 | TGTGGCCTTGAGTAAATCCC | GTTACCTCTCTGAGCCTCGG |
| 282 | LLC12D12 | 202187_s_at | PPP2R5A | CCTCACAACCTGTCCTTCAC | CTAGTCCCTCCTGACCCAGG |
| 283 | IIG4H4 | 205607_s_at | SCYL3 | TAGGCAGTTCCTGACTGTTC | CACATGTAGTACATTGTACC |
| 284 | LLE9F9 | 205130_at | RAGE | CATTTCTGTGATGTGTTGGG | CGTGGTTGGAAGGTGGGTTC |
| 285 | IIIE11F11 | 218854_at | DSE | CTGGTCTCTGCACACATATG | CTTGGTTACTTGCATGCATT |

TABLE 3-continued

Representative Cluster Centroid Landmark Transcripts/Probe Pairs Validated
for LMF (SEQ ID NOS 171-2, 170, respectively, in order of appearance)

| ## | name | Affymetrix | gene symbol | left probe sequence | right probe sequence |
|---|---|---|---|---|---|
| 286 | OOA2B2 | 203857_s_at | PDIA5 | TGTTCTACGCCCCTTGGTGC | CCACACTGTAAGAAGGTCAT |
| 287 | QQE7F7 | 208445_s_at | BAZ1B | ACTGCGGAATGTGGCCTCTG | CTTCCTCCGTCCTCCTGCCC |
| 288 | NNNE4F4 | 203360_s_at | MYCBP | AAAATCCAGAAATAGAGCTG | CTTCGCCTAGAACTGGCCGA |
| 289 | JJC7D7 | 205909_at | POLE2 | AGGACATCTGACTCCCCTAC | CTCTTTATGTCTGCCCAGTG |
| 290 | YYG6H6 | 210563_x_at | CFLAR | CTTGAAGATGGACAGAAAAG | CTGTGGAGACCCACCTGCTC |
| 291 | UC4D4 | 200071_at | SMNDC1 | GGATGTGTGATGTTTATATG | GGAGAACAAAAAGCTGATGT |
| 292 | PA9B9 | 209259_s_at | SMC3 | TTGGAAAATACTACCTACTG | GTTTGGGAGATGTATATAGT |
| 293 | OOC2D2 | 203931_s_at | MRPL12 | TCCAAGGCATCAACCTCGTC | CAGGCAAAGAAGCTGGTGGA |
| 294 | KKE1F1 | 200678_x_at | GRN | CCTGTCAGAAGGGGGTTGTG | GCAAAGCCACATTACAAGC |
| 295 | JJJE9F9 | 202735_at | EBP | CCTGCCAGAAGAGTCTAGTC | CTGCTCCCACAGTTTGGAGG |
| 296 | BC8D8 | 201804_x_at | TBCB | TTGGTGTCCGCTATGATGAG | CCACTGGGAAAAATGATGG |
| 297 | LLE2F2 | 219573_at | LRRC16A | CGGAGTACTGCTAAGTGTAC | CTGTGTCAAATCCGCACAGG |
| 298 | XC8D8 | 201614_s_at | RUVBL1 | GCTGCCGTCCCCACTCAGGC | GTGGTCTGCAGCGCTGTCAG |
| 299 | EEEE10F10 | 336_at | TBXA2R | CCCTGAATTTGACCTACTTG | CTGGGGTACAGTTGCTTCCT |
| 300 | AAG2H2 | 202052_s_at | RAI14 | TTCAGAAAATACACAACAGC | CCCTTCTGCCCCCGCACAGA |
| 301 | RC12D12 | 212899_at | CDC2L6 | TTTCCTGCTTTTGAGTTGAC | CTGACTTCCTTCTTGAAATG |
| 302 | TE3F3 | 202433_at | SLC35B1 | TGGCCTCTGTGATCCTCTTC | GCCAATCCCATCAGCCCCAT |
| 303 | AAG10H10 | 201591_s_at | NISCH | TCTGACTTTCTCTTCTACAC | GTCCTTTCCTGAAGTGTCGA |
| 304 | OG4H4 | 202518_at | BCL7B | TGAGGTTCTGACAACAGTAC | CCATCCCCACAGTACCCCT |
| 305 | RRG4H4 | 219184_x_at | TIMM22 | GCTGAGGGGCTGTTCACCAC | CATCCTCGTTCTCCAGGGTC |
| 306 | WE1F1 | 203334_at | DHX8 | GAAAGGGACAATTTGTGCAG | CTCCAGGATGGGAAGGTGGA |
| 307 | LLLC9D9 | 204517_at | PPIC | GTCACCCTTTAGTTTGCTTG | AACTTTAGTAAACCACCTGC |
| 308 | WA2B2 | 202396_at | TCERG1 | GCATTTGTGGCTTGAACTTG | CCAGATGCAAATACCACAGA |
| 309 | NE2F2 | 218034_at | FIS1 | TTTCTGCTCCCCTGAGATTC | GTCCTTCAGCCCCATCATGT |
| 310 | VC7D7 | 209189_at | FOS | CCCAGTGACACTTCAGAGAG | CTGGTAGTTAGTAGCATGTT |
| 311 | HHG3H3 | 212462_at | MYST4 | TGTACAGGGTGACAGTAAGG | GCCAAGCAGGAGAGGCGTAA |
| 312 | AAG12H12 | 202329_at | CSK | GGGCATTTTACAAGAAGTAC | GAATCTTATTTTTCCTGTCC |
| 313 | JJJG12H12 | 206571_s_at | MAP4K4 | GGAGCTGCACCGAGGGCAAC | CAGGACAGCTGTGTGTGCAG |
| 314 | VG6H6 | 202778_s_at | ZMYM2 | ACTGGGTTCTTAACCAGATG | GTTGTGTATGGGTAGCACTA |
| 315 | OC9D9 | 205376_at | INPP4B | TCAACATGCTACAGCTGATG | GCTTCCCCAAGTACTACAG |
| 316 | FFFG8H8 | 218916_at | ZNF768 | GAAGTGACATGCCCTGGAGA | CTTGTGGGAAGTGGGTTGGA |
| 317 | IIA8B8 | 219499_at | SEC61A2 | CACCGAGCTAAGTCTGTGTG | CAGCATTAGTACCCGCTGCC |
| 318 | JJA12B12 | 218898_at | FAM57A | CCCATTCCTGTGTGTCCGTC | CTGCCATTTAGCCACAGAAG |
| 319 | BBBG1H1 | 220161_s_at | EPB41L4B | CCCTAGTCTGTTGGTAGAAC | CAGAAATCAATATGTTGTCT |
| 320 | RRA6B6 | 200981_x_at | GNAS | GCATGCACCTTCGTCAGTAC | GAGCTGCTCTAAGAAGGGAA |
| 321 | QQC8D8 | 209191_at | TUBB6 | TCGGCCCCTCACAAATGCAG | CCAAGTCATGTAATTAGTCA |
| 322 | RC7D7 | 202776_at | DNTTIP2 | GGAAGTACTCAGAGATCATG | GCTGAAAAGCAGCAAATGC |
| 323 | NNNA6B6 | 203582_s_at | RAB4A | ACAGATGCCCGAATGCTAGC | GAGCCAGAACATTGTGATCA |

TABLE 3-continued

Representative Cluster Centroid Landmark Transcripts/Probe Pairs Validated for LMF (SEQ ID NOS 171-2, 170, respectively, in order of appearance)

| ## | name | Affymetrix | gene symbol | left probe sequence | right probe sequence |
|---|---|---|---|---|---|
| 324 | QQC3D3 | 204977_at | DDX10 | AGATCGAGGGTGGATGATAC | CATTTCCTGACCCCGTTTTC |
| 325 | OOA10B10 | 201412_at | LRP10 | GCACCGGAATGCCAATTAAC | TAGAGACCCTCCAGCCCCCA |
| 326 | RC3D3 | 203367_at | DUSP14 | CACTTTGGGGCCTCATTAAC | CCTTTAGAGACAAGCTTTGC |
| 327 | MMMG8H8 | 201379_s_at | TPD52L2 | GGGTTAAAATCGGCCTGTGG | GGTGTGGTGAGAAGGCAGGT |
| 328 | AAAG3H3 | 203973_s_at | CEBPD | TGCCCGCTGCAGTTTCTTGG | GACATAGGAGCGCAAAGAAG |
| 329 | EEEE12F12 | 212770_at | TLE3 | GTCTCTTGTGGCCCAAACAG | GTTAGGTAGACTATCGCCTC |
| 330 | AAE9F9 | 203192_at | ABCB6 | AACCTCTGAAGACACTAAGC | CTCAGACCATGGAACGGTGA |
| 331 | SSE10F10 | 202180_s_at | MVP | CTGAAATCAACCCTCATCAC | CGATGGCTCCACTCCCATCA |
| 332 | PPC6D6 | 202801_at | PRKACA | TTCAAGGCTAGAGCTGCTGG | GGAGGGGCTGCCTGTTTTAC |
| 333 | JJE9F9 | 209691_s_at | DOK4 | GTGGCAGGAGGATGATAAAG | CACGCGGCCCCTCCCAAGG |
| 334 | LLLA2B2 | 201185_at | HTRA1 | ATGCGTAGATAGAAGAAGCC | CCACGGGAGCCAGGATGGGA |
| 335 | OA9B9 | 207700_s_at | NCOA3 | ATAGTATACTCTCCTGTTTG | GAGACAGAGGAAGAACCAGG |
| 336 | UUG1H1 | 219460_s_at | TMEM127 | TACACCCAGCCCCGAGTGTG | CATCACGGTAAAAGAGCTGA |
| 337 | YG10H10 | 205548_s_at | BTG3 | CATTGTGACCGGAATCACTG | GATTAATCCTCACATGTTAG |
| 338 | RG10H10 | 218039_at | NUSAP1 | AGCTGGGATAGAAAGGCCAC | CTCTTCACTCTCTATAGAAT |
| 339 | LLG4H4 | 218290_at | PLEKHJ1 | CATCCAAAGCCTGAAGCCAG | GTGGGTGTGGGCAGGGGCTG |
| 340 | PPA2B2 | 202328_s_at | PKD1 | GGGCAAGTAGCAGGACTAGG | CATGTCAGAGGACCCCAGGG |
| 341 | XG5H5 | 201976_s_at | MYO10 | GGGGGAGAGACGCTGCATTC | CAGAAACGTCTTAACACTTG |
| 342 | LLG7H7 | 212726_at | PHF2 | CTGGATGTTTTGTCCACTG | GGAGAGGCAGCTTGGTGGAG |
| 343 | YC4D4 | 201000_at | AARS | GAACACACTTGGGAGCAGTC | CTATGTCTCAGTGCCCCTTA |
| 344 | PA8B8 | 210640_s_at | GPER | CCCTCTGTGGAGCGCCCGCC | GTCTGCTCCGGGGTGGTTCA |
| 345 | SSC9D9 | 201727_s_at | ELAVL1 | CACTCCTCTCGCAGCTGTAC | CACTCGCCAGCGCGACGGTT |
| 346 | MMA7B7 | 207290_at | PLXNA2 | GCCTGGCCACCCACACTCTG | CATGCCCTCACCCCACTTCT |
| 347 | HHA12B12 | 210074_at | CTSL2 | GATGGATGGTGAGGAGGAAG | GACTTAAGGACAGCATGTCT |
| 348 | LLLG4H4 | 202087_s_at | CTSL1 | TTCATCTTCAGTCTACCAGC | CCCCGCTGTGTCGGATACAC |
| 349 | OOG3H3 | 209435_s_at | ARHGEF2 | GGGGATTTTTCAGTGGAACC | CTTGCCCCCAAATGTCGACC |
| 350 | JJJC5D5 | 203126_at | IMPA2 | ACCCCAGAGGGAGTTGTCAC | GCTACAGTGAGTGGCTGGCC |
| 351 | YE10F10 | 217722_s_at | NGRN | AATAGGAAGAGGTGTTGAGC | CTGGACTGTGGGAGGAAAGA |
| 352 | ZZC9D9 | 202207_at | ARL4C | GTGGTCACCAGGGGGACAGG | GAGCCCCCCACCAATGTATC |
| 353 | QG7H7 | 206688_s_at | CPSF4 | ATTTTCTCTTGGGGTACGTG | CCTGACAGTGTTTAAGGTGT |
| 354 | NNNC6D6 | 218193_s_at | GOLT1B | TGAAATCCATGTTAATGATG | CTTAAGAAACTCTTGAAGGC |
| 355 | SSC11D11 | 202675_at | SDHB | AAGGCAAGCAGCAGTATCTG | CAGTCCATAGAAGAGCGTGA |
| 356 | XE2F2 | 203266_s_at | MAP2K4 | TGCTGTCAACTTCCCATCTG | GCTCAGCATAGGGTCACTTT |
| 357 | PA7B7 | 201967_at | RBM6 | GTTGGAGCCTCAGGAAGAAC | CAGCAAAAGACAGTCCAACG |
| 358 | IIIG5H5 | 212851_at | DCUN1D4 | AGTGGACAAGAAACCACCAG | CATTGAGCTAACCCAGTACA |
| 359 | UA12B12 | 203640_at | MBNL2 | GGAACTACATTTCACTCTTG | GTTTTCAGGATATAACAGCA |
| 360 | UA6B6 | 201960_s_at | MYCBP2 | TCAACTTGTGAGGTGTTTG | CATGTGGCCATTACCGTCAT |
| 361 | UUC4D4 | 200636_s_at | PTPRF | GTCCTTATTATCCCAGCTTG | CTGAGGGGCAGGGAGAGCGC |

TABLE 3-continued

Representative Cluster Centroid Landmark Transcripts/Probe Pairs Validated for LMF (SEQ ID NOS 171-2, 170, respectively, in order of appearance)

| ## | name | Affymetrix | gene symbol | left probe sequence | right probe sequence |
|---|---|---|---|---|---|
| 362 | NNG11H11 | 202427_s_at | BRP44 | CTTTGTGGGGGCAGCAGGAG | CCTCTCAGCTTTTTCGTATT |
| 363 | AAAA12B12 | 200789_at | ECH1 | TGGCCGAGAGCCTCAACTAC | GTGGCGTCCTGGAACATGAG |
| 364 | AAAE5F5 | 218597_s_at | CISD1 | ACCACCTCTGTCTGATTCAC | CTTCGCTGGATTCTAAATGT |
| 365 | RRA11B11 | 202550_s_at | VAPB | AACTCTGTTGGGTGAACTGG | TATTGCTGCTGGAGGGCTGT |
| 366 | MMMA11B11 | 209337_at | PSIP1 | GGTCATTTGGCACTTCTCAG | CAAGTAGGATACTTCTCATG |
| 367 | OOE3F3 | 208626_s_at | VAT1 | AGGACCTGGGCCATTGCAAC | CAAAATGGGGACTTCCTGGG |
| 368 | NNNE1F1 | 222125_s_at | P4HTM | CCCCGCCAGCCGCGATACGG | CGCAGTTCCTATATTCATGT |
| 369 | KKG9H9 | 200078_s_at | ATP6V0B | TCCAGAGTGAAGATGGGTGA | CTAGATGATATGTGTGGGTG |
| 370 | YA2B2 | 200752_s_at | CAPN1 | CTTCAGGGACTTGTGTACTG | GTTATGGGGGTGCCAGAGGC |
| 371 | WE9F9 | 217874_at | SUCLG1 | TCAGTATGTCTCCTGCACAG | CTGGGAACCACGATCTACAA |
| 372 | HHC4D4 | 212723_at | JMJD6 | ACCCATTCACTTAGCGTTTG | CTCCAGTAGCTTTCCCTCTG |
| 373 | ZZC5D5 | 212811_x_at | SLC1A4 | GAAGGGGAAGATCTGAGAGC | GTGCTGTTTGTGGCTGTTGA |
| 374 | MME4F4 | 212140_at | PDS5A | GGCCCACCCCAATTTTGTAA | CATGATGCAAGTGTCTGGCA |
| 375 | AAE11F11 | 219222_at | RBKS | GCTTACTATCCAAATCTGTC | CTTGGAAGACATGCTCAACA |
| 376 | TTE12F12 | 217950_at | NOSIP | CTGGGGCTGTGGTCACCCTC | GAATGCGTGGAGAAGCTGAT |
| 377 | OOC10D10 | 201432_at | CAT | TTAATACAGCAGTGTCATCA | GAAGATAACTTGAGCACCGT |
| 378 | NNNC1D1 | 218845_at | DUSP22 | TTATCCCCACTGCTGTGGAG | GTTTCTGTACCTCGCTTGGA |
| 379 | YG2H2 | 201314_at | STK25 | GCCTTGTGGTGTTGGATCAG | GTACTGTGTCTGCTCATAAG |
| 380 | MMG9H9 | 202414_at | ERCC5 | AAACCAGTGCTTCAGATTCG | CAGAACTCAGTGAAGGAAGC |
| 381 | PE5F5 | 203659_s_at | TRIM13 | TTCTTTGCCTCAAGACACTG | GCACATTCATTAGCAAGATT |
| 382 | FFFA2B2 | 210241_s_at | TP53TG1 | CATGATGCTGGGGAGCTTGG | CGCCTGACCCAGGATCTAGA |
| 383 | RRE7F7 | 204761_at | USP6NL | TAGTAGAAAACCCGACATTG | ATGTTTCTTCCTGTTGCAAG |
| 384 | XA9B9 | 208946_s_at | BECN1 | ATCTATAGTTGCCAGCCCTG | GTCAGTTTTGATTCTTAACC |
| 385 | CCCE2F2 | 204017_at | KDELR3 | CCTTCAGGCCAGAAGCAAAC | CAAATTTACCAGGTTTGGCT |
| 386 | BBBA1B1 | 204256_at | ELOVL6 | GATGGCAAGGGCTTTTTCAG | CATCTCGTTTATGTGTGGAA |
| 387 | RRC11D11 | 221848_at | ZGPAT | ACTGCTGAGTGGACACAGAG | CTGCGGGGTCCCATCTGGAC |
| 388 | JJG5H5 | 205161_s_at | PEX11A | TGATGTGGGCAGAGATGAGG | CCAAGAACGGAGAAGGGAGG |
| 389 | VC2D2 | 202894_at | EPHB4 | GGTGGAACCCAGAAACGGAC | GCCGGTGCTTGGAGGGGTTC |
| 390 | YG9H9 | 209710_at | GATA2 | CGCTGCAGGGAGCACCACGG | CCAGAAGTAACTTATTTTGT |
| 391 | TTC9D9 | 215980_s_at | IGHMBP2 | AGAGCCTCCCGGCCTTCTCC | GGTGTCCTGTACCAACTCTT |
| 392 | RE9F9 | 203221_at | TLE1 | TTGCCCAAGTGTGAGATTAC | CTTTCTGTTCCTTGCAGTTC |
| 393 | IIC6D6 | 202950_at | CRYZ | AGTTTCCAAGGGTTTTCAAG | CCTACTTACCTTTATAAAGG |
| 394 | OG10H10 | 40562_at | GNA11 | CTCTCCCTCCGTACACTTCG | CGCACCTTCTCACCTTTTGT |
| 395 | RE11F11 | 203302_at | DCK | TCAAAGATGATAATTTAGTG | GATTAACCAGTCCAGACGCA |
| 396 | NNG12H12 | 202545_at | PRKCD | TTCTTCAAGACCATAAACTG | GACTCTGCTGGAAAAGCGGA |
| 397 | PPE11F11 | 203884_s_at | RAB11FIP2 | GGGCCTGTTAGTCTTCGAAG | CTTCCAGATGGTTTGTGTTT |
| 398 | QQE10F10 | 212973_at | RPIA | GGGGTTTCTTCATATTCCTG | CTGTTGGAAGCAGTTGACCA |
| 399 | HHE6F6 | 202452_at | ZER1 | GGCAGGACGGCAGGGGTGAG | CAGCTTTGGGAGAGACACCT |

TABLE 3-continued

Representative Cluster Centroid Landmark Transcripts/Probe Pairs Validated for LMF (SEQ ID NOS 171-2, 170, respectively, in order of appearance)

| ## | name | Affymetrix | gene symbol | left probe sequence | right probe sequence |
|---|---|---|---|---|---|
| 400 | LG6H6 | 221046_s_at | GTPBP8 | TGACCTTTCTGGAATCCAC | CTGTTGAGATGCTTTATAGC |
| 401 | OA8B8 | 201366_at | ANXA7 | AGCTCTGCCTTCCGGAATCC | CTCTAAGTCTGCTTGATAGA |
| 402 | WG12H12 | 202954_at | UBE2C | CCCAGGCTGCCCAGCCTGTC | CTTGTGTCGTCTTTTTAATT |
| 403 | SSA10B10 | 201984_s_at | EGFR | ATCTGTGTGTGCCCTGTAAC | CTGACTGGTTAACAGCAGTC |
| 404 | XA2B2 | 201161_s_at | CSDA | GGGACAGACCTTTGACCGTC | GCTCACGGGTCTTACCCCAT |
| 405 | LLA9B9 | 206173_x_at | GABPB1 | CTGTGGATGGTGCCATTCAG | CAAGTAGTTAGTTCAGGGGG |
| 406 | LA2B2 | 207038_at | SLC16A6 | GACACAAGGAGGCAGAGGAG | CTAACCCCTCTACTCCACTT |
| 407 | AAE10F10 | 202179_at | BLMH | AGACCTAATGCTCCTTGTTC | CTAGAGTAGAGTGGAGGGAG |
| 408 | IIIA1B1 | 209567_at | RRS1 | TGCCTTCATTGAGTTTAAAG | GGACAGGATTGCCCTTCCGT |
| 409 | NNNE10F10 | 209109_s_at | TSPAN6 | CGCCTACTGCCTCTCTCGTG | CCATAACAAATAACCAGTAT |
| 410 | TTA12B12 | 209260_at | SFN | GCATGTCTGCTGGGTGTGAC | CATGTTTCCTCTCAATAAAG |
| 411 | SSG3H3 | 201729_s_at | KIAA0100 | ATGATTTGGCGATTCGAGTG | GCTGCAGTACAGGATCTGAC |
| 412 | HHE10F10 | 209166_s_at | MAN2B1 | GCGCCCCGTTACCTTGAAC | TTGAGGGACCTGTTCTCCAC |
| 413 | LC6D6 | 201794_s_at | SMG7 | GACAAGCTAACCAGGTTTAC | CATCTCACTCCCAGTAATAC |
| 414 | LLA4B4 | 208936_x_at | LGALS8 | AATCACCAATCAAGGCCTCC | GTTCTTCTAAAGATTAGTCC |
| 415 | QQA2B2 | 204788_s_at | PPOX | CAATTCCTGACTGCTCACAG | GTTGCCCCTGACTCTGGCTG |
| 416 | OOE2F2 | 204106_at | TESK1 | GTCTCAGGCCTCCAACTTTG | GCCTTCAGGACACCCTGTAA |
| 417 | MG11H11 | 201849_at | BNIP3 | CAGTTTTCTGCTGAAGGCAC | CTACTCAGTATCTTTTCCTC |
| 418 | TE7F7 | 203685_at | BCL2 | TTTCATTAAGTTTTTCCCTC | CAAGGTAGAATTTGCAAGAG |
| 419 | HHHE11F11 | 205205_at | RELB | GATGTCTAGCACCCCCATCC | CCTTGGCCCTTCCTCATGCT |
| 420 | XA10B10 | 203575_at | CSNK2A2 | GGGTATGCAGAATGTTGTTG | GTTACTGTTGCTCCCCGAGC |
| 421 | MMG2H2 | 202022_at | ALDOC | GCCAGGGCCAAATAGCTATG | CAGAGCAGAGATGCCTTCAC |
| 422 | OOC12D12 | 201817_at | UBE3C | GGGGGGAGGGGATCTAAATC | CTCATTTATCTCTTCTATGT |
| 423 | NNC9D9 | 201236_s_at | BTG2 | GTGTTCTTGCATCTTGTCTG | CAAACAGGTCCCTGCCTTTT |
| 424 | RG7H7 | 210022_at | PCGF1 | CTGATCACATGACAATGAAG | CAGATATGGCTCTCCCGCTG |
| 425 | YYC12D12 | 201565_s_at | ID2 | CTGTGGACGACCCGATGAGC | CTGCTATACAACATGAACGA |
| 426 | NE12F12 | 201186_at | LRPAP1 | AGGACCTCGATGTCCAGCTG | CTGTCAGGTCTGATAGTCCT |
| 427 | SC7D7 | 204324_s_at | GOLIM4 | AAGGCCGAGAGGAACACTAC | GAGGAGGAAGAAGAGGAGGA |
| 428 | KKA3B3 | 213370_s_at | SFMBT1 | GTATCAGCTTGCTCTCTTTG | CACTTTCGGGGAAGGAGGAC |
| 429 | VG1H1 | 201270_x_at | NUDCD3 | AGAGTGAGGTGTCCAGCCTG | CAAAGCTATTCCAGCTCCTT |
| 430 | NC10D10 | 204217_s_at | RTN2 | CTAATTACCTGAGCGACCAG | GACTACATTTCCCAAGAGGC |
| 431 | RRC8D8 | 201707_at | PEX19 | AGATCATCTTTGAGTAGCAC | TGTTTTGGGGCCCTCGGTCT |
| 432 | OOE12F12 | 201963_at | ACSL1 | GAGAGTACATGTATTATATA | CAAGCACAACAGGGCTTGCA |
| 433 | UA8B8 | 203038_at | PTPRK | TTTTTCAGCCTGTGGCCCAG | CACTGGTCAAGAAAACAAGA |
| 434 | RA5B5 | 205202_at | PCMT1 | GATGTCCTGTAAACACTCAG | CTGTTCAGATTGGACATAAC |
| 435 | MME2F2 | 201924_at | AFF1 | GCTCTCAATGGGAAGATGTG | CAACACAAATTAAGGGGAAC |
| 436 | HHA5B5 | 213772_s_at | GGA2 | CTTGTTGCACTGTTCCCAGG | CGAGTGGCTGCCATGAGACC |
| 437 | YYC6D6 | 203773_x_at | BLVRA | ACTGGCTGCTGAAAAGAAAC | GCATCCTGCACTGCCTGGGG |

TABLE 3-continued

Representative Cluster Centroid Landmark Transcripts/Probe Pairs Validated for LMF (SEQ ID NOS 171-2, 170, respectively, in order of appearance)

| ## | name | Affymetrix | gene symbol | left probe sequence | right probe sequence |
|---|---|---|---|---|---|
| 438 | PPA6B6 | 202797_x_at | SACM1L | CAAAGACCAAATCTGAACTG | CTAATGTGGCTGCTTTGTAG |
| 439 | PPE3F3 | 202431_s_at | MYC | CCACAGCATACATCCTGTCC | GTCCAAGCAGAGGAGCAAAA |
| 440 | MMMG6H6 | 209367_at | STXBP2 | GCTCATCGTGTATGTCATGG | GCGGTGTGGCCATGTCAGAG |
| 441 | RRE11F11 | 201361_at | TMEM109 | GAGGTGGATGTCCTTCTCTG | CCAGGCTTGGCACATGATGT |
| 442 | MMME12F12 | 210788_s_at | DHRS7 | TACATGCCAACCTGGGCCTG | GTGGATAACCAACAAGATGG |
| 443 | AAG8H8 | 203119_at | CCDC86 | CTTTCCCAAACCAGTCTCTG | CAGAAGCCCCAGAGAATCTA |
| 444 | SSC8D8 | 1007_s_at | DDR1 | GCTTCTTCCTCCTCCATCAC | CTGAAACACTGGACCTGGGG |
| 445 | OG7H7 | 203304_at | BAMBI | GGCACGGGAAGCTGGAATTC | GTATGACGGAGTCTTATCTG |
| 446 | DDC2D2 | 201007_at | HADHB | TTTCAATAATCAGTTTACTG | CTCTTTCAGGGATTTCTAAG |
| 447 | RRC7D7 | 201710_at | MYBL2 | CCCATTCTCATGTTTACAGG | GGTTGTGGGGGCAGAGGGGG |
| 448 | NNE2F2 | 204729_s_at | STX1A | CATGTTTGGGATGGTGGCTC | CTGTTGTCTTGCGCTCTGGG |
| 449 | IIE8F8 | 217398_x_at | GAPDH | CTGCCACCCAGAAGACTGTG | GATGGCCCCTCCGGGAAACT |
| 450 | LA1B1 | 209899_s_at | PUF60 | TAGCCTCTGAGACTCATAAG | GCCATCCAGGCCCTCAATGG |
| 451 | HHHC7D7 | 212660_at | PHF15 | GCAATAGAATGTATGGTCAC | CTGGGTGTGGCCAGTGCCCG |
| 452 | CCCC5D5 | 206723_s_at | LPAR2 | GCAGCAGAGACTGAGGGGTG | CAGAGTGTGAGCTGGGAAAG |
| 453 | TG2H2 | 202423_at | MYST3 | ATCCCCTGTGAATCAGAGTG | CACAAGCACCTCTCCTGTGA |
| 454 | RE6F6 | 203570_at | LOXL1 | ACCAACAACGTGGTGAGATG | CAACATTCACTACACAGGTC |
| 455 | UUE4F4 | 202738_s_at | PHKB | ACATCCTTGGCGGGGTTATG | GACCTCTTGCATGTCATAGC |
| 456 | UUA4B4 | 221610_s_at | STAP2 | TTGGCCAGTCATCCTGAAGC | CAAAGAAGTTGCCAAAGCCT |
| 457 | SSC4D4 | 204549_at | IKBKE | TCACCACTGCCAGCCTCAGG | CAACATAGAGAGCCTCCTGT |
| 458 | VE7F7 | 203596_s_at | IFIT5 | GACTTAATTGGCATGGGGTG | CAGTCCAGGCATCATGATTT |
| 459 | UUE11F11 | 218255_s_at | FBRS | ACCTCTTAATGGCTCAGTCC | CCTTCACCCCATTTCCAAGT |
| 460 | PC2D2 | 201528_at | RPA1 | TCCCCTAAGGAAATCCGAGC | GGCTACAAAGCGTTTCTTTA |
| 461 | IIG9H9 | 201738_at | EIF1B | CTGCCTTGTGAAATGATTCC | CTGCAGTAAACGGACTTTTC |
| 462 | TG3H3 | 201146_at | NFE2L2 | CCTGCAGCAAACAAGAGATG | GCAATGTTTTCCTTGTFCCC |
| 463 | RRG6H6 | 221081_s_at | DENND2D | ATTGATTTCTCAGGACTTTG | GAGGGCTCTGACACCATGCT |
| 464 | TTC7D7 | 218529_at | CD320 | GCCCTGTGCTTAAGACACTC | CTGCTGCCCCGTCTGAGGGT |
| 465 | KKKC10D10 | 218086_at | NPDC1 | CCTCGGATGAGGAGAATGAG | GACGGAGACTTCACGGTGTA |
| 466 | HHHG8H8 | 219051_x_at | METRN | GACGCTGAGCTGCTCCTGGC | CGCATGCACCAGCGACTTCG |
| 467 | JJJA7B7 | 201014_s_at | PAICS | AACATCTGCGCATAAAGGAC | CAGATGAAACTCTGAGGATT |
| 468 | MMC7D7 | 200757_s_at | CALU | AGAGCCTCACACCTCACTAG | GTGCAGAGAGCCCAGGCCTT |
| 469 | CCCE4F4 | 201212_at | LGMN | TCCAGGACCTTCTTCACAAG | ATGACTTGCTCGCTGTTACC |
| 470 | XC3D3 | 212850_s_at | LRP4 | CTGGCGAGCCCTTAGCCTTG | CTGTAGAGACTTCCGTCACC |
| 471 | WE12F12 | 201243_s_at | ATP1B1 | AAAGCTGTGTCTGAGATCTG | GATCTGCCCATCACTTTGGC |
| 472 | PPE4F4 | 202696_at | OXSR1 | CCCCTTGTCCCTGGAGTAGG | GACTAACTATAGCACAAAGT |
| 473 | IIA12B12 | 222217_s_at | SLC27A3 | GGCCGTTGCAGGTGTACTGG | GCTGTCAGGGATCTTTTCTA |
| 474 | NNA5B5 | 212795_at | KIAA1033 | CTGGAAACGAATTTAAATGG | TGTCAAACTGCAGAGCAACA |
| 475 | MMMA1B1 | 212815_at | ASCC3 | CTGCCGCATAAACTATAAAT | CTGTAAGGTGGTACACAGCG |

TABLE 3-continued

Representative Cluster Centroid Landmark Transcripts/Probe Pairs Validated for LMF (SEQ ID NOS 171-2, 170, respectively, in order of appearance)

| ## | name | Affymetrix | gene symbol | left probe sequence | right probe sequence |
|---|---|---|---|---|---|
| 476 | JJC1D1 | 203512_at | TRAPPC3 | AAGCCACCCAGGTCTCATTC | CTCCCTGCTGTTGGAGGCAA |
| 477 | TTC10D10 | 218948_at | QRSL1 | ATGCGCATGGCAAGAACTTG | CCTTACCCCAGATTCTCTAT |
| 478 | XE10F10 | 209224_s_at | NDUFA2 | CCCTTTGAACAACTTCAGTG | CTGATCAGGTAACCAGAGCC |
| 479 | JJA7B7 | 205811_at | POLG2 | TAGGAAGAGGCCCCACATTG | GAACTAAGACAGGTTTGTCA |
| 480 | JJJE11F11 | 204608_at | ASL | CTCAAGGGACTTCCCAGCAC | CTACAACAAAGACTTACAGG |
| 481 | LE6F6 | 209161_at | PRPF4 | TACAGTGAAGAAGACTTCAC | CTCTTCCTATTGAGTTTGCT |
| 482 | JJJC12D12 | 205120_s_at | SGCB | CTCTTCAAGGTGCAAGTAAC | CAGCCAGAACATGGGCTGCC |
| 483 | ZZC2D2 | 208634_s_at | MACF1 | ACCAGTAACTCTTGTGTTCA | CCAGGACCCAGACCCTTGGC |
| 484 | YG4H4 | 202160_at | CREBBP | TTCTTGAATTCATGTACATG | GTATTAACACTTAGTGTTCG |
| 485 | AAE7F7 | 201807_at | VPS26A | CAAAAGGGTCCATGTACCAC | CATGTGCTGGAGCATCTGTT |
| 486 | ME4F4 | 205406_s_at | SPA17 | GCCTTCCGGGGACACATAGC | CAGAGAGGAGGCAAAGAAAA |
| 487 | AAC2D2 | 214404_x_at | SPDEF | CCCCTGAGTTGGGCAGCCAG | GAGTGCCCCCGGGAATGGAT |
| 488 | HHA6B6 | 57703_at | SENP5 | ATGCCCCGAGTGCGGAAGAG | GATTTACAAGGAGCTATGTG |
| 489 | YA3B3 | 213720_s_at | SMARCA4 | GATGCATGTGCGTCACCGTC | CACTCCTCCTACTGTATTTT |
| 490 | QQA4B4 | 212047_s_at | RNF167 | AGCTTCTCCCTTACCCACAC | CTATCCTTTTGAGGGGCTTT |
| 491 | LLLG11H11 | 202083_s_at | SEC14L1 | CACCCAGCGGCGACATTGTA | CAGACTCCTCTCACCTCTAG |
| 492 | PPG11H11 | 203919_at | TCEA2 | CCGTTGACACAGCTTCTCTG | GAGACCCTAGAAGGCGGCAT |
| 493 | QC6D6 | 200666_s_at | DNAJB1 | CTCTGTATAGGGCCATAATG | GAATTCTGAAGAAATCTTGG |
| 494 | AAG5H5 | 203409_at | DDB2 | GTTAAAGGGCCAAAAGTATC | CAAGGTTAGGGTTGGAGCAG |
| 495 | PPA4B4 | 202623_at | EAPP | GGAAGATGCTGCCGAGAAGG | CAGAGACAGATGTGGAAGAA |
| 496 | LLE10F10 | 212955_s_at | POLR2I | CACGAAGTGGACGAACTGAC | CCAGATTATCGCCGACGTGT |
| 497 | PPE1F1 | 202241_at | TRIB1 | CTAGAAACACTAGGTTCTTC | CTGTACATACGTGTATATAT |
| 498 | QG6H6 | 203054_s_at | TCTA | CCCACCCACTAATACTACTG | CACAGAGTCAGGATCTCACA |
| 499 | HHHA10B10 | 204514_at | DPH2 | GTTCAGACAGCCACATGAGG | GGACAGTGCAGCTACAGGAT |
| 500 | KKKC3D3 | 208872_s_at | REEP5 | AATTAAAGCTATAGAGAGTC | CCAACAAAGAAGATGATACC |
| 501 | NNG8H8 | 201125_s_at | ITGB5 | TGAGTCCTGAGACTTTTCCG | CGTGATGGCTATGCCTTGCA |
| 502 | JJJE7F7 | 201127_s_at | ACLY | GGGGTACAGGCACCGAAGAC | CAACATCCACAGGCTAACAC |
| 503 | OG9H9 | 201558_at | RAE1 | GGGTTGAGGTTATTGTAGAC | GTTAGATTGCGGGCACCGCC |
| 504 | KKE8F8 | 201664_at | SMC4 | GGTTTACCAGGATGTAGTCC | CACTGTTGAGGAGCATCTAT |
| 505 | SA1B1 | 203026_at | ZBTB5 | TGCCTCTCCACTGCTAGATG | GAACCTGGAATCTCTCATCT |
| 506 | KKA6B6 | 202025_x_at | ACAA1 | AATGAGCTGAAGCGCCGTGG | GAAGAGGGCATACGGAGTGG |
| 507 | MMG3H3 | 204978_at | SFRS16 | CAAGATCCGCATGAAGGAGC | GGGAACGCCGAGAGAAGGAG |
| 508 | AAG1H1 | 202732_at | PKIG | ACCTCTGCCCTGTCCACCAG | GATAAGTGACACCTAGGACC |
| 509 | LLA12B12 | 205667_at | WRN | AAATCAGCCTTCCGCAATTC | ATGTAGTTTCTGGGTCTTCT |
| 510 | NG1H1 | 202038_at | UBE4A | CATGCCAGAGGCTGATGCTG | CACTGTTGATGTCATGTGAG |
| 511 | HHA4B4 | 89476_r_at | NPEPL1 | AGGACCCTCTGCTGAACCTG | GTGTCCCCACTGGGCTGTGA |
| 512 | KKKG3H3 | 208950_s_at | ALDH7A1 | CCTAAAGGATCAGACTGTGG | CATTGTAAATGTCAACATTC |
| 513 | RRG3H3 | 218788_s_at | SMYD3 | ATGCGACGCCAACATCAGAG | CATCCTAAGGGAACGCAGTC |

TABLE 3-continued

Representative Cluster Centroid Landmark Transcripts/Probe Pairs Validated for LMF (SEQ ID NOS 171-2, 170, respectively, in order of appearance)

| ## | name | Affymetrix | gene symbol | left probe sequence | right probe sequence |
|---|---|---|---|---|---|
| 514 | JJE8F8 | 209045_at | XPNPEP1 | AGATGCCCCGACTTCTTTGG | CCAGTGATGGGGAATCAGTG |
| 515 | LLG2H2 | 219459_at | POLR3B | CCTGGCTTTTGTCGTGGTGG | CTGGCTCGGATAAATTTTCC |
| 516 | QQG9H9 | 206050_s_at | RNH1 | CTGGCTCTGTGCTGCGGGTG | CTCTGGTTGGCCGACTGCGA |
| 517 | LLG10H10 | 218064_s_at | AKAP8L | GCAAGAAGCTGGAGCGCTAC | CTGAAGGGCGAGAACCCTTT |
| 518 | HHHE7F7 | 202185_at | PLOD3 | TGAATATGTCACCTTGCTCC | CAAGACACGGCCCTCTCAGG |
| 519 | WWE4F4 | 201145_at | HAX1 | CTCAGGGGCTTGGATATGTG | GAATAGTGAACTGGGGCCAT |
| 520 | PPG6H6 | 202812_at | GAA | AATAAGATTGTAAGGTTTGC | CCTCCTCACCTGTTGCCGGC |
| 521 | VC9D9 | 202125_s_at | TRAK2 | ATGCATGCAGACCTGTACTC | CACATGCAACCCAACAGCAG |
| 522 | WA3B3 | 202927_at | PIN1 | CCGAATTGTTTCTAGTTAGG | CCACGCTCCTCTGTTCAGTC |
| 523 | MMG12H12 | 203306_s_at | SLC35A1 | ACTCGGACAATTTCTGGGTG | GTGACTGAGTACCCCTTTAG |
| 524 | PG11H11 | 203727_at | SKIV2L | ACATCGTATTTGCGGCCAGC | CTCTACACCCAGTGAATGCC |
| 525 | KKC11D11 | 202829_s_at | VAMP7 | ATGGTACCTGTTCTTCTATC | CAAACCTTTCAATTCATGCT |
| 526 | KKC8D8 | 201513_at | TSN | ACTTAAGTGGCTAAAGAGAT | GAGACAAACATGCAGGTCGC |
| 527 | EEA10B10 | 220964_s_at | RAB1B | CCCCTCTGGTGTCATGTCAG | GCATTTTGCAAGGAAAAGCC |
| 528 | LLE5F5 | 203897_at | LYRM1 | GGTAGAGTCAGGTGAGAGTC | CCTTGGTGAGTCATTTGTAC |
| 529 | AAA9B9 | 203573_s_at | RABGGTA | GCCCTGCCCCCTACCCTTGC | CCTTTAACTTATTGGGACTG |
| 530 | TTE1F1 | 204089_x_at | MAP3K4 | CATTACTACTGTACACGGAC | CATCGCCTCTGTCTCCTCCG |
| 531 | MMMG2H2 | 219076_s_at | PXMP2 | TCCGGGTGCTCTTCGCCAAC | CTGGCAGCTCTGTTCTGGTA |
| 532 | MMC5D5 | 212648_at | DHX29 | ACGTCTTCTTTCTATTGATG | GCTGGATCTATTTTCAGGCC |
| 533 | ZZA9B9 | 212614_at | ARID5B | GTTGGCTGTTAGTGTATTTG | ATATTCTGCCTGTCTCCTCA |
| 534 | FFFC2D2 | 210986_s_at | TPM1 | CAGCTCATGACAATCTGTAG | GATAACAATCAGTGTGGATT |
| 535 | OOG1H1 | 203616_at | POLB | GGAAATACCGGGAACCCAAG | GACCGGAGCGAATGAGGCCT |
| 536 | AAA11B11 | 202491_s_at | IKBKAP | TTCCACTCATTCCTGTTGTC | CTACCACCCCTTGCTCTTTG |
| 537 | QQC9D9 | 212500_at | ADO | GTGTGCATAAACTGTTAGTC | GTGACTGACTTGGTGTGTTG |
| 538 | EEEC11D11 | 202720_at | TES | TACTTCCAAGCCTGTCCATG | GATATATCAAATGTCTTCAC |
| 539 | HHG10H10 | 214259_s_at | AKR7A2 | TGAAAGGTGGGGGTGAGTC | CCACTTGAGCGCTTCCTGTT |
| 540 | TG11H11 | 201594_s_at | PPP4R1 | TCTTCACATACTGTACATAC | CTGTGACCACTCTTGGGAGT |
| 541 | PA6B6 | 217933_s_at | LAP3 | ACCAACAAAGATGAAGTTCC | CTATCTACGGAAAGGCATGA |
| 542 | UG3H3 | 202868_s_at | POP4 | AGCCAATTCCATTTATAGAC | CACCTCCAGCCAGTGACGCT |
| 543 | IIA4B4 | 202949_s_at | FHL2 | CCAGGCAATCTTGCCTTCTG | GTTTCTTCCAGCCACATTGA |
| 544 | UC9D9 | 209341_s_at | IKBKB | TTTGTTGGAGAAGAAAGTTG | GAGTAGGAGACTTTCACAAG |
| 545 | ZZG4H4 | 201811_x_at | SH3BP5 | GATTTATTCTAAGAGAAGTG | CATGTGAAGAATGGTTGCCA |
| 546 | YYC9D9 | 204143_s_at | ENOSF1 | ACCGATCAAGATGAGTTCAG | CTAGAAGTCATACCACCCTC |
| 547 | UUE7F7 | 217931_at | CNPY3 | AAACTCACCATCCCTCAGTC | CTCCCCAACAGGGTACTAGG |
| 548 | MG10H10 | 209100_at | IFRD2 | GGAGACTTTCTATGCCCTTG | GTCCGTATTTTTAACAGAAG |
| 549 | ZA3B3 | 201466_s_at | JUN | TGCGATGTTTCAGGAGGCTG | GAGGAAGGGGGTTGCAGTG |
| 550 | VE5F5 | 202830_s_at | SLC37A4 | GGCCATCATTCTCACTGTAC | CACTAGGCGCAGTTGGATAT |
| 551 | ZZC8D8 | 218910_at | ANO10 | TGAGTGAGCCACCAGCTCTC | CACGTTCCCCTCATAGCAGT |

TABLE 3-continued

Representative Cluster Centroid Landmark Transcripts/Probe Pairs Validated for LMF (SEQ ID NOS 171-2, 170, respectively, in order of appearance)

| ## | name | Affymetrix | gene symbol | left probe sequence | right probe sequence |
|---|---|---|---|---|---|
| 552 | SSA12B12 | 203530_s_at | STX4 | GACAGTTCTTCTGGGGTTGG | CAGCTGCTCATTCATGATGG |
| 553 | LLE7F7 | 203562_at | FEZ1 | GCGGGGTCCTTTGCCGTTGG | CTTCTAGTGCTAGTAATCAT |
| 554 | NE11F11 | 209364_at | BAD | GGCGGAAGTACTTCCCTCAG | GCCTATGCAAAAAGAGGATC |
| 555 | PPG9H9 | 203405_at | PSMG1 | TTGTCCATTGCTAGAACAAC | CGAATATAGTACACGACCTT |
| 556 | JJE2F2 | 203885_at | RAB21 | GTTCAGTGGTATGAGCAGAG | GAAGAGATCCCAGATAGTAG |
| 557 | NNE6F6 | 219170_at | FSD1 | AAGCGAGGCAGTGCTACCAG | CAGCTCCAACACCAGCCTCA |
| 558 | UE8F8 | 207939_x_at | RNPS1 | CGTTCATGGTGGTCTTTCAG | GTTATCTTGGCAACATGTAC |
| 559 | MMMG5H5 | 221492_s_at | ATG3 | GTGATGAAGAAAATCATTGA | GACTGTTGCAGAAGGAGGGG |
| 560 | HHC3D3 | 210719_s_at | HMG20B | GACCCTGGTGGGGGTGGCTC | CTTCTCACTGCTGGATCCGG |
| 561 | HHE8F8 | 204605_at | CGRRF1 | AGAATGGGACTGTGAACTGG | GTACTCTTACCATGCAGACA |
| 562 | PPC2D2 | 218450_at | HEBP1 | ATAGACCAGAAAAATCCTGG | CAGCTTTTCTCCAGGCATCT |
| 563 | ZG2H2 | 212049_at | WIPF2 | TCTCAGTCCCTGGCCATGTG | GTCAAGGTGGCTTTCTGTTA |
| 564 | PPC11D11 | 203848_at | AKAP8 | GCCCTGCTGTGTCAGTTTCC | CTGTGGCCTTTTGAACTGTA |
| 565 | NNA2B2 | 204587_at | SLC25A14 | ACTTGGGCTAGAGCAGAAGG | CATAGGCCAGGGTGGTTATT |
| 566 | BBBE8F8 | 204418_x_at | GSTM2 | TCTCCCGATTTGAGGGCTTG | GAGAAGATCTCTGCCTACAT |
| 567 | YC1D1 | 203047_at | STK10 | TTCTCTTCAGGAAGAAAAAG | CATCAGGGGGAAATGGAATG |
| 568 | IIC2D2 | 205451_at | FOXO4 | GTGTCAGCGCCTGGCCTACC | CAGATTGTATCATGTGCTAG |
| 569 | PE11F11 | 203346_s_at | MTF2 | ACGTCGGGTGACACTTGATG | GAAAGGTGCAGTATCTTGTG |
| 570 | OOE6F6 | 218571_s_at | CHMP4A | GGCTCCCTTCTCTTTGATAG | CAGTTATAATGCCCTTGTTC |
| 571 | RG9H9 | 203241_at | UVRAG | GGTGTCTGGTAGGCAAACTG | CAAGGCAGTTGAGATAGTTG |
| 572 | OOG11H11 | 201695_s_at | NP | GATGCCCAGGATTTGACTCG | GGCCTTAGAACTTTGCATAG |
| 573 | RE8F8 | 203764_at | DLGAP5 | TTTCCTTCATATTATCAATG | CTTATATATTCCTTAGACTA |
| 574 | NNG10H10 | 201631_s_at | IER3 | CTTTGTGGGACTGGTGGAAG | CAGGACACCTGGAACTGCGG |
| 575 | SSG5H5 | 214221_at | ALMS1 | GGTGATTAAAATTCCTAATG | GTTTGGGAGCAATACTTTCT |
| 576 | JJG12H12 | 219742_at | PRR7 | GCTTGGCGTCTGCCGGTCTC | CATCCCCTTGTTCGGGAGGA |
| 577 | LE12F12 | 202016_at | MEST | TGATTCCTTTATGATGACTG | CTTAACTCCCCACTGCCTGT |
| 578 | WA11B11 | 202108_at | PEPD | GCTTCGGCATTTGATCAGAC | CAAACAGTGCTGTTTCCCGG |
| 579 | MMA8B8 | 201074_at | SMARCC1 | GGAGTCCGAGAAGGAAAATG | GAATTCTGGTTCATACTGTG |
| 580 | PE6F6 | 202780_at | OXCT1 | CCACATGGTTAAATGCATAC | CTTCCCAGTACTGGGGGAA |
| 581 | HHHG11H11 | 209253_at | SORBS3 | CTAGCCTGGCTCAAATATTC | CCCAGGGAGACTGCTGTGTG |
| 582 | NE6F6 | 203256_at | CDH3 | TACAGTGGACTTTCTCTCTG | GAATGGAACCTTCTTAGGCC |
| 583 | PC8D8 | 208398_s_at | TBPL1 | AGCAGAGCTGTCACAGTGTG | CACTACCTTAGATTGTTTTA |
| 584 | OOE10F10 | 201519_at | TOMM70A | TCTCCCTTCTTTCATCTTGG | GGTTGGGTAGAGAAACACAA |
| 585 | LA10B10 | 217745_s_at | NAT13 | ACTATGTTAGTTGCATTTAG | GTTTTAAAGCAAAGAATCTG |
| 586 | ZA11B11 | 210811_s_at | DDX49 | AGGAGATCAACAAACGGAAG | CAGCTGATCCTGGAGGGGAA |
| 587 | NNC11D11 | 201887_at | IL13RA1 | GGTCTTGGGAGCTCTTGGAG | GTGTCTGTATCAGTGGATTT |
| 588 | PPG3H3 | 202447_at | DECR1 | ACCAAGGAGCAGTGGGACAC | CATAGAAGAACTCATCAGGA |
| 589 | SC12D12 | 202749_at | WRB | GAAATGTTTAGGGACATCTC | CATGCTGTCACTTGTGATTT |

TABLE 3-continued

Representative Cluster Centroid Landmark Transcripts/Probe Pairs Validated for LMF (SEQ ID NOS 171-2, 170, respectively, in order of appearance)

| ## | name | Affymetrix | gene symbol | left probe sequence | right probe sequence |
|---|---|---|---|---|---|
| 590 | IIE6F6 | 204285_s_at | PMAIP1 | CCGCTGGCCTACTGTGAAGG | GAGATGACCTGTGATTAGAC |
| 591 | KKA10B10 | 201036_s_at | HADH | GAATGGGTCAGCATATCTCT | GTTTGCATGGTTTGCAGGAG |
| 592 | NNE3F3 | 207877_s_at | NVL | CGGCAGAGAATCCCCACAC | GCTCTGAAGGACCCACTTTC |
| 593 | RRG7H7 | 203806_s_at | FANCA | GGAACCCACAGACCTCACAC | CTGGGGGACAGAGGCAGATA |
| 594 | RRG12H12 | 201819_at | SCARB1 | CACTGCATCGGGTTGTCTGG | CGCCCTTTTCCTCCAGCCTA |
| 595 | OG12H12 | 201709_s_at | NIPSNAP1 | CTGTTCCCTCACCCTGTATC | CTGTCTCCCCTAATTGACAT |
| 596 | OOC7D7 | 221741_s_at | YTHDF1 | TGAGTTGAAGCATGAAAATG | GTGCCCATGCCTGACGCTCC |
| 597 | KKE10F10 | 202916_s_at | FAM20B | CAATTCCTCAAGTCTGGGTG | GTGACAAGGTAGGGGCTAGG |
| 598 | SG4H4 | 202148_s_at | PYCR1 | GGTTTCCAGCCCCCAGTGTC | CTGACTTCTGTCTGCCACAT |
| 599 | LC1D1 | 218316_at | TIMM9 | CAGTAGCCACCATGTTCAAC | CATCTGTCATGACTGTTTGG |
| 600 | QQC10D10 | 212894_at | SUPV3L1 | CCAGCCCCGATGCAGGAGAG | CTGTCCCTTGCTTCCAGATT |
| 601 | QQA12B12 | 215903_s_at | MAST2 | GCCAAGAACCAGGGGCCAT | CAAAAGCATCGGGATTTGGC |
| 602 | PPG8H8 | 203285_s_at | HS2ST1 | TGCAGTGGCTGAACAAAGAG | CATGGCTTGAGAATCAAAGG |
| 603 | SE4F4 | 203594_at | RTCD1 | AAACAGGACCAGTTACACTC | CATACGCAAACCGCGATACA |
| 604 | UUA2B2 | 219384_s_at | ADAT1 | TACTACCTAGAGAAAGCCAG | CAAAGAATGAAGGCAACAAA |
| 605 | SSE9F9 | 201825_s_at | SCCPDH | ATTGATGCTGCCTCATTCAC | GCTGACATTCTTTGGTCAAG |
| 606 | RC5D5 | 204168_at | MGST2 | CCTAGGTGCCCTGGGAATTG | CAAACAGCTTTCTGGATGAA |
| 607 | AAAA6B6 | 221227_x_at | COQ3 | AGAAACAGAAGAGCTCCAAG | CTAATGCCTGCACCAATCCA |
| 608 | UUC2D2 | 219390_at | FKBP14 | TAGGACTTAAGCTGATGAAG | CTTGGCTCCTAGTGATTGGT |
| 609 | YG8H8 | 202184_s_at | NUP133 | AGTTCTTGTCCTGGTTCTAG | CTGCTCACATGTACAAATCA |
| 610 | VE2F2 | 202521_at | CTCF | ATATGTAATGGGGTTGAAAG | CTGGGGAGGAGGATCTACTG |
| 611 | MMMC2D2 | 209215_at | MFSD10 | TCAGTGACTCCGAGCTGCAG | CACTCCAAGGCTGTCAGGGC |
| 612 | OOE8F8 | 201174_s_at | TERF2IP | CCTTCTCAGTCAAGTCTGCC | GGATGTCTTTCTTTACCTAC |
| 613 | PG1H1 | 217758_s_at | TM9SF3 | ATCTGTTCAGGTTGGTGTAC | CGTGTAAAGTGGGGATGGGG |
| 614 | LLC7D7 | 212453_at | KIAA1279 | CCTTGTAAGAAAAAATGCTG | GGTAATGTACCTGGTAACAA |
| 615 | NNNE9F9 | 218435_at | DNAJC15 | CAAGGCTAAGATTAGAACAG | CTCATAGGAGAGTCATGATT |
| 616 | TTC11D11 | 209911_x_at | HIST1H2BD | CCACCCAAATCCAACTCATC | CTGGTTTGCTGCACACTGGT |
| 617 | BBBE10F10 | 212115_at | HN1L | GGGAGAAGAAGAGTTCCTGC | GCATGCAAGCCCTGCTGTGT |
| 618 | KKA7B7 | 217995_at | SQRDL | GCTAAGGGGTTACTGGGGAG | GACCAGCGTTTCTGCGCAAG |
| 619 | LLLC5D5 | 210058_at | MAPK13 | CCTTCCTTGGCTCTTTTTAG | CTTGTGGCGGCAGTGGGCAG |
| 620 | IIC5D5 | 218642_s_at | CHCHD7 | TTGCAGGATGAGTTGGGCAG | GGAAAAGGGTCAGGGTTCAT |
| 621 | ZC5D5 | 204000_at | GNB5 | GCCCAGCCCTTCTTCTAGTG | GTAGCTCTGGCTTTGCAGGC |
| 622 | MMA4B4 | 208249_s_at | TGDS | TGATTCGGACAACCATGAGG | GGTAGTGGTGCTAGGGAGAA |
| 623 | FFFC8D8 | 218068_s_at | ZNF672 | AGGCCAAAACCATGTGGGTG | CACAAAGCCAGGCACTGCCA |
| 624 | AAAC10D10 | 217901_at | DSG2 | CAAAGGATTTATATAGTGTG | CTCCCACTAACTGTACAGAT |
| 625 | YYA6B6 | 213419_at | APBB2 | GAACTAACGCTGCGTCCTTG | GAATGAATGATGCGTGAGTT |
| 626 | MC2D2 | 202683_s_at | RNMT | ATTCCCTTCCAGTTAACTAC | CTCTCCAAGGGAAACCACTA |
| 627 | PPA10B10 | 203456_at | PRAF2 | TGCCCCTCACCCCAATGTTC | CACACCATCGACAACCAAGG |

TABLE 3-continued

Representative Cluster Centroid Landmark Transcripts/Probe Pairs Validated for LMF (SEQ ID NOS 171-2, 170, respectively, in order of appearance)

| ## | name | Affymetrix | gene symbol | left probe sequence | right probe sequence |
|---|---|---|---|---|---|
| 628 | PG5H5 | 201266_at | TXNRD1 | TCACGTCCTCATCTCATTTG | GCTGTGTAAAGAAATGGGAA |
| 629 | SSG1H1 | 202261_at | VPS72 | GAAGTACATTACTGCCCATG | GACTGCCGCCCACTGCCTCA |
| 630 | QQE8F8 | 209460_at | ABAT | CAGCAGAAGCTGGTAAAAAC | ATGGGGAGCCCGGAGGACAG |
| 631 | RC9D9 | 213390_at | ZC3H4 | TGTGGATGAAATAGAAGCTG | GAGCCCTCCTCTTGGAATAT |
| 632 | HHHG4H4 | 205036_at | LSM6 | ATCAGTACACAGAAGAGACG | GATGTGAAGACACCAAGAGA |
| 633 | JJE4F4 | 204937_s_at | ZNF274 | GCCTTTTCAGCTTGACCCTG | CAATATAACATGCACAGGCC |
| 634 | MMMA4B4 | 212624_s_at | CHN1 | TGCGTCCTGGGTAGTCTGTG | CTTGTAATCCAGCATGTTTC |
| 635 | SE9F9 | 218350_s_at | GMNN | CCTCCACTAGTTCTTTGTAG | CAGAGTACATAACTACATAA |
| 636 | JJA3B3 | 204484_at | PIK3C2B | ATAACTGGAGAAAGAAGCTC | CATTGACCGAAGCCACAGGG |
| 637 | PPC1D1 | 202230_s_at | CHERP | AATCGGCCACACCTGGTGTC | CATGGGCAGCCTGGTGCAAT |
| 638 | QQE1F1 | 204617_s_at | ACD | CCTTCCAGTATGAGTATGAG | CCACCCTGCACGTCCCTCTG |
| 639 | KKE6F6 | 202761_s_at | SYNE2 | TTGAGCTGCCGGTTATACAC | CAAAATGTTCTGTTCAGTAC |
| 640 | MMC10D10 | 202756_s_at | GPC1 | TCAGGAGCCCCAACACAGG | CAAGTCCACCCCATAATAAC |
| 641 | RRA10B10 | 204808_s_at | TMEM5 | TTGCTCCTATGGCTCCATTC | CTGTGGTGGAAGACGTGATG |
| 642 | JJE6F6 | 205450_at | PHKA1 | CCTAATCACTCCAACCCTGC | CCCTTTCTGTCCCATCCTTC |
| 643 | XG10H10 | 201875_s_at | MPZL1 | CTTTCCTGGTTGCAGATAAC | GAACTAAGGTTGCCTAAAGG |
| 644 | KKKA12B12 | 221482_s_at | ARPP19 | GAAAGATTTGTATCTCTGTG | CTTGAACTTGAATGGCCTTA |
| 645 | KKA11B11 | 202598_at | S100A13 | AAATCAGGAAGAAGAAAGAC | CTGAAGATCAGGAAGAAGTA |
| 646 | JJG11H11 | 218215_s_at | NR1H2 | CTTGCCTGACCACCCTCCAG | CAGATAGACGCCGGCACCCC |
| 647 | XG6H6 | 202689_at | RBM15B | CACTAAGGACATTGGGCAAG | CTAGAAGAAGAACACATGGT |
| 648 | OOC3D3 | 218050_at | UFM1 | CCCCGTTTCTTACAATAAAT | GTTGAGTCTTAGTTAAGCAG |
| 649 | IIIC6D6 | 205963_s_at | DNAJA3 | TGGTAGCATGTCGCAGTTTC | CATGTGTTTCAGGATCTTCG |
| 650 | IIIA5B5 | 201561_s_at | CLSTN1 | CCCTGACTGCTAGTTCTGAG | GACACTGGTGGCTGTGCTAT |
| 651 | RC8D8 | 201899_s_at | UBE2A | GCTGACTGGGCACACTCATG | CCAAGTTTCAGAATTATTGG |
| 652 | UUA7B7 | 219127_at | ATAD4 | CAAGTCACACACCCTCAAAG | GGAAGCTACACGGGCCAAAT |
| 653 | MMC11D11 | 202811_at | STAMBP | GGGTGAGGGACAGCTTACTC | CATTTGACCAGATTGTTTGG |
| 654 | ZZG6H6 | 208847_s_at | ADH5 | ATCCTGTCGTGATGTGATAG | GAGCAGCTTAACAGGCAGGG |
| 655 | NNG4H4 | 212485_at | GPATCH8 | CAAACACAACTCTTGACTGC | CCTCCCACCCTCCTACCTGT |
| 656 | RRA4B4 | 218852_at | PPP2R3C | GCTTCTGGACTTACGAGAAC | AGAGAGGCTCTTGTTGCAAA |
| 657 | MA12B12 | 221732_at | CANT1 | GTGGCTGAATTGAGACCTTG | CTGATGTATTCATGTCAGCA |
| 658 | UUE6F6 | 218780_at | HOOK2 | CCTGGCATCTCTGAACCTTC | GCCCCACTGACAAGCACTGA |
| 659 | HHG12H12 | 217870_s_at | CMPK1 | TCATCAGGTATCTTTCTGTG | GCATTTGAGAACAGAAACCA |
| 660 | HHA8B8 | 203709_at | PHKG2 | TGAAGAGGAGGGAGACTCTG | CTGCTATAACTGAGGATGAG |
| 661 | JJG9H9 | 209724_s_at | ZFP161 | GGGGCAGTACCAGTCCATAC | CAGCTGCGATTTGTGAGTGG |
| 662 | ZZA3B3 | 202889_x_at | MAP7 | ACTTCCATGTACAACAAACG | CTCCGGGAAATGGAAAGCCA |
| 663 | TTA11B11 | 218809_at | PANK2 | CAGTTGACTGGTTTTGTGTC | CTGTTTGAACTTGCTGAATG |
| 664 | LG11H11 | 201489_at | PPIF | CAATGTGAATTCCTGTGTTG | CTAACAGAAGTGGCCTGTAA |
| 665 | IIC10D10 | 201767_s_at | ELAC2 | CCCTGCACACCAGAGACAAG | CAGAGTAACAGGATCAGTGG |

TABLE 3-continued

Representative Cluster Centroid Landmark Transcripts/Probe Pairs Validated for LMF (SEQ ID NOS 171-2, 170, respectively, in order of appearance)

| ## | name | Affymetrix | gene symbol | left probe sequence | right probe sequence |
|---|---|---|---|---|---|
| 666 | LLC10D10 | 212070_at | GPR56 | TTGCTGGCCTGTTGTAGGTG | GTAGGGACACAGATGACCGA |
| 667 | NNNA9B9 | 200929_at | TMED10 | CTAAGGCATCCTACCAACAG | CACCATCAAGGCACGTTGGA |
| 668 | AAAC2D2 | 220094_s_at | CCDC90A | GAAATAGTGGCATTGCATGC | CCAGCAAGATCGGGCCCTTA |
| 669 | OOA5B5 | 212833_at | SLC25A46 | TCAGAGACAACATCCTTGTC | CATATCCAAACCCAGTGTTT |
| 670 | YE2F2 | 202371_at | TCEAL4 | CTTTTGACCTATCTGCAATG | CAGTGTTCTCAGTAGGAAAT |
| 671 | RRG1H1 | 218249_at | ZDHHC6 | CTGGTTAAGATGTTCTTTTC | CTCAAAGGTGCCCTAGTGCC |
| 672 | PPE9F9 | 203395_s_at | HES1 | TCCCTCCGGACTCTAAACAG | GAACTTGAATACTGGGAGAG |
| 673 | IIE4F4 | 205562_at | RPP38 | GGCTCAGTGAGAGAATCGCC | CCCGTCATTGGCTTAAAATG |
| 674 | QQG5H5 | 205750_at | BPHL | GGTGGTTCCTTCGTGTGGGG | CTTGATCGTGTTGCTGCCTG |
| 675 | JJC11D11 | 212871_at | MAPKAPK5 | GTGATAGAAGAGCAAACCAC | GTCCCACGAATCCCAATAAT |
| 676 | HHC6D6 | 201620_at | MBTPS1 | TCTTCTGACTGCAGGGGAAG | GATGTACTTTCCAAACAAAT |
| 677 | UC7D7 | 202996_at | POLD4 | GAGGCACCACGTAAGACCTC | CTGCCCTTAGCTCTCTTGCT |
| 678 | IIIG12H12 | 218826_at | SLC35F2 | CAAAGAGTATGCCTGGGAGC | CTCCAGCTGTTAAAAGACAA |
| 679 | RC10D10 | 202626_s_at | LYN | GGGATCATCTGCCGTGCCTG | GATCCTGAAATAGAGGCTAA |
| 680 | GGE5F5 | 218397_at | FANCL | TCTTGGTATAAATACACTTC | CACAGTCAGCACGGGGATCA |
| 681 | HHC2D2 | 201548_s_at | KDM5B | TCAGCAAAGCTACAGGACTG | GTACTCAAGCCAGCCTGTAA |
| 682 | YE5F5 | 213689_x_at | FAM69A | CACACGTATACTCAGATTTG | GCATGTACCTTTCAACATCT |
| 683 | VG8H8 | 201223_s_at | RAD23B | CCCCTTCCCTCAGCAGAAAC | GTGTTTATCAGCAAGTCGTG |
| 684 | BBBC12D12 | 203627_at | IGF1R | AAGCAGTCAATGGATTCAAG | CATTCTAAGCTTTGTTGACA |
| 685 | MMMG1H1 | 217867_x_at | BACE2 | TATTAAGAAAATCACATTTC | CAGGGCAGCAGCCGGGATCG |
| 686 | UG2H2 | 204952_at | LYPD3 | CTTCTCATCCTTGTCTCTCC | GCTTGTCCTCTTGTGATGTT |
| 687 | KKG7H7 | 221449_s_at | ITFG1 | GGAAAAGAAAGCAGATGATA | GAGAAAAACGACAAGAAGCC |
| 688 | MMA12B12 | 203124_s_at | SLC11A2 | TTGGCTCCCTTGAGGTTCTG | CTAGTGGTGTTAGGAGTGGT |
| 689 | EEE10F10 | 202362_at | RAP1A | AATATGATTATACAAAAGAG | CATGGATGCATTTCAAATGT |
| 690 | MMME7F7 | 212449_s_at | LYPLA1 | TAATAAAGGCTAGTCAGAAC | CCTATACCATAAAGTGTAGT |
| 691 | VVC12D12 | 209015_s_at | DNAJB6 | GCCGTTCATGTTGCTTTCTC | CTTTGTCCTCTTGGACTTGA |
| 692 | MMC4D4 | 209662_at | CETN3 | ATGGAGAAATAAACCAAGAG | GAGTTCATTGCTATTATGAC |
| 693 | CC5D5 | 200618_at | LASP1 | GGGGTTGTTGTCTCATTTTG | GTCTGTTTTGGTCCCCTCCC |
| 694 | DDA9B9 | 217971_at | MAPKSP1 | TACATTGATCCACTTGAGCC | GTTAAGTGCTGCCAATTGTA |
| 695 | LE9F9 | 218595_s_at | HEATR1 | AGTGCCAAAAGACTATTCAG | CAACTGGAAACTGTCCTGGG |
| 696 | KKA9B9 | 201735_s_at | CLCN3 | GTCTCGAAGGAAGCGAGAAC | GAAATCTCTCATTGTGTGCC |
| 697 | QQC11D11 | 213531_s_at | RAB3GAP1 | GGAGCTCAAGATGTCTTGTG | TCTGTGTGGCTAGATGGCCT |
| 698 | SSG11H11 | 203447_at | PSMD5 | AAATTATTTTAAAGTGACTG | GAATTATCTAGTCCCCAGAT |
| 699 | HHHC6D6 | 212345_s_at | CREB3L2 | GGTTTTAGCTCTGTTCTCTG | CTCCCATCCTTCGCTCACCA |
| 700 | JJG8H8 | 209179_s_at | MBOAT7 | CCCTGGGCAGTGGGTTTTGG | GCAAATTCCCTTTCTTTGCA |
| 701 | JJE3F3 | 202093_s_at | PAF1 | GTGATGCTGATTCTGAGGAC | GATGCCGACTCTGATGATGA |
| 702 | UUG3H3 | 219363_s_at | MTERFD1 | TTTGTGCACAATGTGATGAG | CATTCCCACCACATCATTG |
| 703 | WWA8B8 | 203094_at | MAD2L1BP | GATTTCCTGATAGGCTGATG | GCATGTGGCTGTGACTGTGA |

TABLE 3-continued

Representative Cluster Centroid Landmark Transcripts/Probe Pairs Validated for LMF (SEQ ID NOS 171-2, 170, respectively, in order of appearance)

| ## | name | Affymetrix | gene symbol | left probe sequence | right probe sequence |
|---|---|---|---|---|---|
| 704 | MC3D3 | 202458_at | PRSS23 | TGACACAGTGTTCCCTCCTG | GCAGCAATTAAGGGTCTTCA |
| 705 | HHA10B10 | 202708_s_at | HIST2H2BE | AGTGATTCAGCTGTTTTTGG | CTAAGGGCTTTTGGAGCTGA |
| 706 | OE5F5 | 202847_at | PCK2 | AGTCTAGCAAGAGGACATAG | CACCCTCATCTGGGAATAGG |
| 707 | IIIG3H3 | 201331_s_at | STAT6 | GCTGCATCTTTTCTGTTGCC | CCATCCACCGCCAGCTTCCC |
| 708 | MMA6B6 | 218961_s_at | PNKP | AAGGCTTCTCTGCCATCCTG | GAGATCCCGTTCCGGCTATG |
| 709 | TTA2B2 | 211015_s_at | HSPA4 | GGCAGATAGACAGAGAGATG | CTCAACTTGTACATTGAAAA |
| 710 | QE1F1 | 212231_at | FBXO21 | CTCCAGGAAGCCTGTATCAC | CTGTGTAAGTTGGTATTTGG |
| 711 | TTE11F11 | 215497_s_at | WDTC1 | CCGAGCCTTTTGTTGCTCC | GCTCCCAGGAGAGTGAGGGT |
| 712 | RRC4D4 | 219016_at | FASTKD5 | CTCGGCTTGGCTACCGTGTG | GTAGAGTTATCCTACTGGGA |
| 713 | LLA2B2 | 218542_at | CEP55 | TGTTCCCCAACTCTGTTCTG | CGCACGAAACAGTATCTGTT |
| 714 | OOG5H5 | 218358_at | CRELD2 | GATGTCCCGTGGAAAATGTG | GCCCTGAGGATGCCGTCTCC |
| 715 | SC11D11 | 209586_s_at | PRUNE | CCTACCCCACAGCTCTGTTC | CATGTAAGTTGCCAACAGTT |
| 716 | FFFC1D1 | 218113_at | TMEM2 | ATGGCCTCTACCTTTGTATC | CAGGAGAAACTGCAGAGCAG |
| 717 | TTA8B8 | 220661_s_at | ZNF692 | ACTGGGCTGTAGGGGAGCTG | GACTACTTTAGTCTTCCTAA |
| 718 | VE6F6 | 209394_s_at | ASMTL | CATGCTGGTGCAGACTGAAG | GCAAGGAGCGGAGCCTGGGC |
| 719 | PE7F7 | 202109_at | ARFIP2 | TTGCTGCCCTGTCTATCTTC | CTGGCCACAGGGCTTCATTC |
| 720 | MG5H5 | 202528_at | GALE | AGGCTCTGGCACAAAACCTC | CTCCTCCCAGGCACTCATTT |
| 721 | LLG11H11 | 201870_at | TOMM34 | GTTTTTGTTCCAACAGTGG | CCTTCTCCGGGCTTCATAGT |
| 722 | BBBC7D7 | 210473_s_at | GPR125 | GGACCAATTAAAAGCAATGG | GCAGGAGGGACCCTTGCTCG |
| 723 | IIIC9D9 | 218744_s_at | PACSIN3 | GGCTGAGGGCAAGATGGGAG | GTCAGAGGTGACAGAAGCGT |
| 724 | WC1D1 | 1053_at | RFC2 | TACAGGTGCCCTATTCTGAG | GTACAGGAGCCGCGGCTTTC |
| 725 | JJE11F11 | 217809_at | BZW2 | ATGGAGCCCTGAGGCATCAG | CTATTATACTTGGGACTCTA |
| 726 | TTE8F8 | 219270_at | CHAC1 | ACAGGCCCTGGCAACCTTCC | CAGTCTGTCCCATACTGTTA |
| 727 | KKE7F7 | 219082_at | AMDHD2 | TCGACGACTCCCTTCACGTC | CAGGCCACCTACATCTCGGG |
| 728 | YG7H7 | 201968_s_at | PGM1 | CATGCCCTCCTGCATTGCTG | CTGCGTGGGTATTTGTCTCC |
| 729 | SE3F3 | 202722_s_at | GFPT1 | GCAGTGTATGCTCATACTTG | GACAGTTAGGGAAGGGTTTG |
| 730 | QQG4H4 | 205251_at | PER2 | CTCTCAGAGTTTCTGTGATG | ATTTGTTGAGCCTTGCTGGA |
| 731 | UUG7H7 | 201416_at | SOX4 | GCACGCTCTTTAAGAGTCTG | CACTGGAGGAACTCCTGCCA |
| 732 | OOG10H10 | 201531_at | ZFP36 | CTCAAATTACCCTCCAAAAG | CAAGTAGCCAAAGCCGTTGC |
| 733 | JJJE5F5 | 203336_s_at | ITGB1BP1 | CTGAAGACCACAGATGCAAG | CAATGAGGAATACAGCCTGT |
| 734 | FFFE1F1 | 212282_at | TMEM97 | CCATATTGGCCCGATTAGTG | GTACTGTCTGACTCACGTGT |
| 735 | KKA5B5 | 213995_at | ATP5S | TGTGCAAGTGTCATTATATC | GAGGATGACTGTTTGCTGAG |
| 736 | AAA4B4 | 213918_s_at | NIPBL | GGAGTCAACGTATTTCGCAG | CGTATTACGTAAAATGATTT |
| 737 | PPC7D7 | 202854_at | HPRT1 | ACTATGAGCCTATAGACTAT | CAGTTCCCTTTGGGCGGATT |
| 738 | KKA1B1 | 221549_at | GRWD1 | GAGGTGTGGGTTCCTCCAAC | ACAATTTGCTTCTGCCCGTT |
| 739 | LLLA3B3 | 202900_s_at | NUP88 | CCATTATTCTCAGTGCCTAC | CAGCGAAAGTGCATTCAGTC |
| 740 | NA2B2 | 201673_s_at | GYS1 | GCCCACTGTGAAACCACTAG | GTTCTAGGTCCTGGCTTCTA |
| 741 | RE5F5 | 217777_s_at | PTPLAD1 | AGGCTCAGCCCACCCCAACC | CTATCTCATGTTCAGTCTGT |

TABLE 3-continued

Representative Cluster Centroid Landmark Transcripts/Probe Pairs Validated for LMF (SEQ ID NOS 171-2, 170, respectively, in order of appearance)

| ## | name | Affymetrix | gene symbol | left probe sequence | right probe sequence |
|---|---|---|---|---|---|
| 742 | MME1F1 | 200843_s_at | EPRS | TCAAACCACTCTGTGAACTG | CAGCCTGGAGCCAAATGTGT |
| 743 | RRE1F1 | 218175_at | CCDC92 | GGCACCGATCACCGAGCAGC | CGTGCGTGTATCTCAAGGAA |
| 744 | HHG11H11 | 204711_at | KIAA0753 | GGCTCAGTGAAGGAAACATG | CAGAAAGAATGCCTGAGACG |
| 745 | NA11B11 | 218001_at | MRPS2 | TCAATCTAAATGCCTTTCAG | GTGGGCCGCTTCCTTGGCTA |
| 746 | PPA11B11 | 203775_at | SLC25A13 | CAGACAGAAAAACTGAGAT | GTAGCCCCTCTCCTGGAAGT |
| 747 | QQE6F6 | 205895_s_at | NOLC1 | GGGAACCCTCAGGTCTCTAG | GTGAGGGTCTTGATGAGGAC |
| 748 | HHHG12H12 | 209262_s_at | NR2F6 | TAGCATGAACTTGTGGGATG | GTGGGGTTGGCTTCCCTGGC |
| 749 | IIIE8F8 | 218828_at | PLSCR3 | CTGCCTTCAGCTGGTGCTTG | CTGCGATTCCTGTGCCTTAT |
| 750 | AAAC11D11 | 203303_at | DYNLT3 | GAGCGGAACCATAACTCATT | GAATTTTGGAGAGGAATAAG |
| 751 | TTE3F3 | 216913_s_at | RRP12 | CCTGGACTCAGGATGACTTG | GAACTAGGGCTTGGCTCTCA |
| 752 | OOA11B11 | 201572_x_at | DCTD | AGCTTACTGCAGCACTGTTG | GTGTTCGGAGCTCTTCTGTG |
| 753 | MMA10B10 | 202734_at | TRIP10 | GGACCTATGCACTTTATTTC | TGACCCCGTGGCTTCGGCTG |
| 754 | OE1F1 | 203258_at | DRAP1 | GAAGATTACGACTCCTAGCG | CCTTCTGCCCCCCAGACCAT |
| 755 | GGA6B6 | 217734_s_at | WDR6 | TTGTAGTAGGAGCTGAAATC | CATGCTGAGCTGTACCAGGA |
| 756 | XC10D10 | 203905_at | PARN | TTGAAACAGATCACAGCAAC | GACAAACGCTCATGGCGCTG |
| 757 | ME7F7 | 218577_at | LRRC40 | ATTGACTTGAATATGACTAG | CCAGTTTCTATGTTTTTGTT |
| 758 | BBBG7H7 | 209409_at | GRB10 | ACAGTATGACCGATCTCTGC | GCCTTTCTGGGGCGGGCAA |
| 759 | NG11H11 | 201098_at | COPB2 | TCCTACTCCGGTTATTGTGG | CCTCCCACACAGCCAACAAA |
| 760 | TTC3D3 | 216321_s_at | NR3C1 | GTCCACCCAGGATTAGTGAC | CAGGTTTTCAGGAAAGGATT |
| 761 | VA10B10 | 201995_at | EXT1 | AGAAATACCGAGACATTGAG | CGACTTTGAGGAATCCGGCT |
| 762 | JJC3D3 | 204742_s_at | PDS5B | TGCTGCAGTGCAACAGGAGG | CTTTTTCAGTGATCTTCACT |
| 763 | SSE2F2 | 212180_at | CRKL | CAGGAGGAACAGTGGCCTTG | CTTCTTAGACGGTCTTCACT |
| 764 | HHA3B3 | 203171_s_at | RRP8 | ACAAGCGCAGGTGACCTCTG | GATCTTCCTTGAAAGGGGAG |
| 765 | MMMC5D5 | 209608_s_at | ACAT2 | CTTTGCAGCTGTCTCTGCTG | CAATAGTTAAAGAACTTGGA |
| 766 | PPA8B8 | 203046_s_at | TIMELESS | CCTTTGGCTTTCTCTTGGAG | GTGGGTCGCAGCACCAGATG |
| 767 | QG9H9 | 203341_at | CEBPZ | CAAACAGCTTAGATGGGAGG | CTGAACGTGATGACTGGCTA |
| 768 | OOA8B8 | 201153_s_at | MBNL1 | TCCAGCCTTCACTCCAGCTG | GTTAAAAATGTTGCACTTAT |
| 769 | NC6D6 | 207831_x_at | DHPS | AAACCTTTGCCCAGAAGATG | GATGCCTTCATGCATGAGAA |
| 770 | IIE10F10 | 201778_s_at | KIAA0494 | GTCACAGTTGAGGATTTTGG | CTGTGATGGGCTCATACTCA |
| 771 | JJA10B10 | 210151_s_at | DYRK3 | GTATTGCCAAAACTGATTAG | CTAGTGGACAGAGATATGCC |
| 772 | OOG6H6 | 218743_at | CHMP6 | GTTATGAGACGATCTCGCTG | GGACCGCCCCTGCCCGTGGA |
| 773 | IIC8D8 | 200791_s_at | IQGAP1 | AAGGCCACATCCAAGACAGG | CAATAATGAGCAGAGTTTAC |
| 774 | IIG1H1 | 205055_at | ITGAE | CTTGGAGAGCATCAGGAAGG | CCCAGCTGAAATCAGAGAAT |
| 775 | MMMG4H4 | 201503_at | G3BP1 | AAGAAGGAATGTTACTTTAA | TATTGGACTTTGCTCATGTG |
| 776 | HHC5D5 | 217900_at | IARS2 | GTCTTCAGATACACTGTGTC | CTCGATGTGCAGAAGTTGTC |
| 777 | JJE7F7 | 206015_s_at | FOXJ3 | TTTTGTGCAGATACAACCTG | CTCTCTGTACTGCTGTTGGA |
| 778 | KKKA5B5 | 210153_s_at | ME2 | CCAGTGAAACTTACAGATGG | GCGAGTCTTTACACCAGGTC |
| 779 | NNNA7B7 | 203328_x_at | IDE | GGAAATGTTGGCAGTAGATG | CTCCAAGGAGACATAAGGTA |

TABLE 3-continued

Representative Cluster Centroid Landmark Transcripts/Probe Pairs Validated for LMF (SEQ ID NOS 171-2, 170, respectively, in order of appearance)

| ## | name | Affymetrix | gene symbol | left probe sequence | right probe sequence |
|---|---|---|---|---|---|
| 780 | RRC2D2 | 218474_s_at | KCTD5 | GCATCCTCTCTGGGGAGCTG | CTGGCCGCTTAGCGTTGTTT |
| 781 | ZZC4D4 | 202429_s_at | PPP3CA | ACCCAAACAAAGATGTTCTC | GATACAGTCTGGCAAAGACT |
| 782 | RRA9B9 | 203911_at | RAP1GAP | TGGCCCCAATACCCATTTTG | GAAGCCCTGTGGCCGTGTG |
| 783 | LLLG7H7 | 215116_s_at | DNM1 | ACTACCAGAGAACGCTGTCC | CCCGACATCCCACTCCAAAG |
| 784 | IIIG2H2 | 213844_at | HOXA5 | AACTCCCTTGTGTTCCTTCT | GTGAAGAAGCCCTGTTCTCG |
| 785 | TTG11H11 | 218547_at | DHDDS | GCATCTCTCTTTGGCCTGAG | GTTCTGTATTCTGGGAAAGG |
| 786 | TG5H5 | 203521_s_at | ZNF318 | ATTGAACTCATTCCCTGTTC | CACAAACCCATATGTATCCT |
| 787 | TG7H7 | 213150_at | HOXA10 | CTAGGAGGACTGGGGTAAGC | GGAATAAACTAGAGAAGGGA |
| 788 | TG9H9 | 203720_s_at | ERCC1 | GTACCTGGAGACCTACAAGG | CCTATGAGCAGAAACCAGCG |
| 789 | NNA1B1 | 203546_at | IPO13 | AGAGGCGGGTGAAGGAGATG | GTGAAGGAGTTCACACTGCT |
| 790 | IIG10H10 | 202388_at | RGS2 | TGCAGTGTCCGTTATGAGTG | CCAAAAATCTGTCTTGAAGG |
| 791 | XC12D12 | 200617_at | MLEC | TTTCCCATCCTCTCTCTGTG | GAGGCCAAACCAACTCTTTG |
| 792 | OC7D7 | 213233_s_at | KLHL9 | ACCAAGGCAAAATGAATTGG | CTTCTAGGGGTCTGAACCTT |
| 793 | SG12H12 | 212997_s_at | TLK2 | TCCGTCTGGTCTCCTGTTTG | CAATTGCTTCCCTCATCTCA |
| 794 | JJA11B11 | 212689_s_at | KDM3A | GGCTGTAAAAGCAAAACCTC | GTATCAGCTCTGGAACAATA |
| 795 | HHC9D9 | 212189_s_at | COG4 | CAGCAGAGAAACAAAGTCTG | GACCCACTCCATGCTCTGCC |
| 796 | OOC1D1 | 202911_at | MSH6 | TAGGACATATGGCATGCATG | GTAGAAAATGAATGTGAAGA |
| 797 | NNNE3F3 | 200698_at | KDELR2 | ACAAAAGCTCTGTAGGGCTG | CAGACATTTAAAGTTCACAT |
| 798 | VVG7H7 | 201913_s_at | COASY | GTCCAAGCTATACTGTGCAG | GACATGGCCAGGCCTGGTGG |
| 799 | SE10F10 | 202604_x_at | ADAM10 | GCTCGACCACCTCAACATTG | GAGACATCACTTGCCAATGT |
| 800 | MMA1B1 | 202910_s_at | CD97 | TGTCCCATCCTGGACTTTTC | CTCTCATGTCTTTGCTGCAG |
| 801 | VG9H9 | 205051_s_at | KIT | TCTATGCTCTCGCACCTTTC | CAAAGTTAACAGATTTTGGG |
| 802 | LLLA6B6 | 202772_at | HMGCL | GCTGGCAGAGGCCATTTGTG | GAAAGTGGAGAGCTACGTGG |
| 803 | KKC3D3 | 218667_at | PJA1 | GTTCCCTCCCCACTCTAAA | GACCAAGGCCGTTTACTCCT |
| 804 | CCCG3H3 | 203726_s_at | LAMA3 | GGTGGCAGTCACCATAAAAC | AACACATCCTGCACCTGGAA |
| 805 | KKKA10B10 | 217960_s_at | TOMM22 | CGGAGAAGTTGCAAATGGAG | CAACAGCAGCAACTGCAGCA |
| 806 | RRE3F3 | 218755_at | KIF20A | TCCTACGCTCACGGCGTTCC | CCTTTACTCAAATCTGGGCC |
| 807 | RRE4F4 | 219069_at | ANKRD49 | GATAGTCCTACCTCACCCTG | GTCAACCTACATGATCCTTA |
| 808 | OOA1B1 | 202880_s_at | CYTH1 | TTTCCTAGACAGAGAGGCAC | CTGGGTCAGTATTAGTCTAT |
| 809 | RE4F4 | 200825_s_at | HYOU1 | AGCTAGGGCTGCTGCCTCAG | CTCCAAGACAAGAATGAACC |
| 810 | LA4B4 | 214061_at | WDR67 | TCTTTTGGCTGCATAGAATG | CATGTCACCTTGAGACGGTC |
| 811 | SE7F7 | 204772_s_at | TTF1 | CACTAAAATCCAGACTCCTG | CAGCACCCAAGCAAGTTTTC |
| 812 | NNA9B9 | 201178_at | FBXO7 | GTGGTATGACCCAAAGGTTC | CTCTGTGACAAGGTTGGCCT |
| 813 | LLC6D6 | 204611_s_at | PPP2R5B | GTCTATTTATTCTCGCCCAG | CTCACCCTCTACACAGACAC |
| 814 | ZG3H3 | 202500_at | DNAJB2 | ACCCTGCTGCCCATTCTTTC | CAACATCACAGATGAACTGC |
| 815 | YYC11D11 | 201347_x_at | GRHPR | GTAGCCAAACAGTAGAGATG | GAGGGCCGGGAAGCAAACCG |
| 816 | RA7B7 | 214106_s_at | GMDS | TGGGTCGCTTTGCGTTTGTC | GAAGCCTCCTCTGAATGGCT |
| 817 | ZZG7H7 | 205640_at | ALDH3B1 | AAACCTACATTTGGACAATG | AGAGGCTGCTCCTGCGGCCT |

TABLE 3-continued

Representative Cluster Centroid Landmark Transcripts/Probe Pairs Validated for LMF (SEQ ID NOS 171-2, 170, respectively, in order of appearance)

| ## | name | Affymetrix | gene symbol | left probe sequence | right probe sequence |
|---|---|---|---|---|---|
| 818 | HHHA9B9 | 205379_at | CBR3 | GACAGGATTCTGGTGAATGC | GTGCTGCCCAGGACCAGTGA |
| 819 | OA12B12 | 204662_at | CP110 | AGCTTATTCATAGCATTGTG | GGTCTCTCCAGTAAGAAAGA |
| 820 | YA4B4 | 202174_s_at | PCM1 | AAGCTCTCTGGCTGGAAGTC | CTGATACTGAATCTCCAGTG |
| 821 | JJJG7H7 | 201351_s_at | YME1L1 | CAGAAACCCAATCTGCCATC | GAACAAGAAATAAGAATCCT |
| 822 | ZE7F7 | 202032_s_at | MAN2A2 | AGAAACTAGCCAAGGGCAAG | CTATTATTCAGCAGTGTCCC |
| 823 | AAAE10F10 | 205741_s_at | DTNA | CTGTCACCACAGAGATTGGC | CTACGGTTTCTGTTTTGAGG |
| 824 | GGGA6B6 | 220091_at | SLC2A6 | GCCCAACCTCTGGGAACAGG | CAGCTCCTATCTGCAAACTG |
| 825 | AAAE3F3 | 203213_at | CDC2 | AAGTCTTACAAAGATCAAGG | GCTGTCCGCAACAGGGAAGA |
| 826 | BBBE12F12 | 205227_at | IL1RAP | CGTTCCATGCCCAGGTTAAC | AAAGAACTGTGATATATAGA |
| 827 | LA3B3 | 203566_s_at | AGL | TGCTTCATACTTGAGTGATG | CTGGATAAGGTATTGTATTT |
| 828 | LC5D5 | 214741_at | ZNF131 | CGTTGAAACACATTGATTCC | CCTCCCCCTACTTATTGCCA |
| 829 | YYA11B11 | 213343_s_at | GDPD5 | AGCAGACCTCAAGGCAGAAG | GGTCACCTAACCCAGGAGTC |
| 830 | LLLG6H6 | 210115_at | RPL39L | ACTTGAAAAGTGGTGTGTGT | GTTGACTCTGTTTCTCGCCA |
| 831 | LLC4D4 | 218104_at | TEX10 | GAGGAGCTGCCTGTTGTGGG | CCAGCTGCTTCGACTGCTGC |
| 832 | EEEE7F7 | 203127_s_at | SPTLC2 | AAAATTGGCGCCTTTGGACG | GGAGATGCTGAAGCGGAACA |
| 833 | RRG9H9 | 203209_at | RFC5 | ACGCACTTGTTTTCATGCAG | GAGCGGGGCAAGTAAGGTTG |
| 834 | IIA11B11 | 202441_at | ERLIN1 | CCCTCTCAGCTCTGAGGCTG | GCCGTCTTTCGGGGTGTTCC |
| 835 | KKA8B8 | 201011_at | RPN1 | AAACCAGGCCCTGCGTCAGG | CAGTGTGAGTTTGCCGTTTG |
| 836 | BBBE7F7 | 219327_s_at | GPRC5C | ATGGGTGTCCCCACCCACTC | CTCAGTGTTTGTGGAGTCGA |
| 837 | IIA7B7 | 205085_at | ORC1L | GCCGTGTGTTCTCACCTGGG | CTCCTGTCGCCTCCTGCTTG |
| 838 | VVC7D7 | 210416_s_at | CHEK2 | CTGTCTGAGGAAAATGAATC | CACAGCTCTACCCCAGGTTC |
| 839 | LLG6H6 | 212830_at | MEGF9 | CCCTAGAAAGTAAGCCCAGG | GCTTCAGATCTAAGTTAGTC |
| 840 | AAAA7B7 | 214074_s_at | CTTN | TGTGTTTTAAACAGAATTTC | GTGAACAGCCTTTTATCTCC |
| 841 | KKC7D7 | 202908_at | WFS1 | CCTGCCAGTGTTTAGAAGAG | CCTGACTGTGTTCAGTGCCT |
| 842 | HHE4F4 | 212968_at | RFNG | CGCTCTGACTTGTGGCTCAG | GACTACTTTCTGGGTCGTGC |
| 843 | IIIE1F1 | 212665_at | TIPARP | CTGTTGTTTGCTGCCATTGG | CATGAAATGGCCAACTGTGG |
| 844 | WWG11H11 | 208717_at | OXA1L | TTTTCCCTGGTCCAAGTATC | CTGTCTCCGGATTCCAGCAG |
| 845 | LC4D4 | 203557_s_at | PCBD1 | TTTAGACCTTTTCCCTGCAC | CACTCTCTTCATCCTGGGGG |
| 846 | AAE2F2 | 201579_at | FAT1 | AGTGTAACGGGGACCTTCTG | CATACCTGTTTAGAACCAAA |
| 847 | SSA5B5 | 202006_at | PTPN12 | GTTTCTGAATTTTAAACTTG | CTGGATTCATGCAGCCAGCT |
| 848 | OOE4F4 | 211783_s_at | MTA1 | GTTTACTTTTTGGCTGGAGC | GGAGATGAGGGGCCACCCCG |
| 849 | YA7B7 | 201260_s_at | SYPL1 | TTGTTTCCTGTCCTTTGTTG | CTCATGCTGTTTAAGTGCAG |
| 850 | QQC1D1 | 215884_s_at | UBQLN2 | GAAGGATCAGTGTAGTAATG | CCAGGAAAGTGCTTTTTACC |
| 851 | IIIA2B2 | 203418_at | CCNA2 | CTCATGGACCTTCACCAGAC | CTACCTCAAAGCACCACAGC |
| 852 | TTG12H12 | 221779_at | MICALL1 | GGAAGAGGCTCGCTCCCGCC | CATGGTCATCACTGGTCTGT |
| 853 | JJJG3H3 | 203167_at | TIMP2 | AAGAAGAGCCTGAACCACAG | GTACCAGATGGGCTGCGAGT |
| 854 | KKA12B12 | 204998_s_at | ATF5 | AGTGTTTCGTGAAGGTGTTG | GAGAGGGGCTGTGTCTGGGT |
| 855 | MA11B11 | 217830_s_at | NSFL1C | CCCTGCAATGAGCCAAGAAC | CAACACTACATCCACCTAGA |

TABLE 3-continued

Representative Cluster Centroid Landmark Transcripts/Probe Pairs Validated for LMF (SEQ ID NOS 171-2, 170, respectively, in order of appearance)

| ## | name | Affymetrix | gene symbol | left probe sequence | right probe sequence |
|---|---|---|---|---|---|
| 856 | ZZA7B7 | 217761_at | ADI1 | AATTCCGAGATAGGATTATG | CCTAGTTTGTCATATCACAG |
| 857 | ZZE12F12 | 218168_s_at | CABC1 | GAGCTGGGAGAGGTGCTGAG | CTAACAGTGCCAACAAGTGC |
| 858 | MMC6D6 | 219821_s_at | GFOD1 | AAAGTGAGCCTAGCCAGGAG | GTGTTTGGGGCTCTATCGCG |
| 859 | IIIE3F3 | 203648_at | TATDN2 | TGCAGGTGAAACCAACCAGC | CCTGTGTTAGAGGAGGAAAA |
| 860 | MA3B3 | 203250_at | RBM16 | GTCAAGGAAATGAATAACAG | CTTGTCAGAGACTTCCTATG |
| 861 | RA2B2 | 202040_s_at | KDM5A | AGCCCTGACCCCAATGTCTG | CTGTTTCCAACACTGGTGAT |
| 862 | ZZC12D12 | 211725_s_at | BID | CCTGGAGCAGCTGCTGCAGG | CCTACCCTAGAGACATGGAG |
| 863 | SG6H6 | 203208_s_at | MTFR1 | TTCCTGGCTGGGAGTATTAG | GAGATGGGAGTAGAGATTCA |
| 864 | TTG8H8 | 220140_s_at | SNX11 | AGACAATGAGGCATTCTGTC | CTCCTGCTGCCATTCTTCAT |
| 865 | UUA12B12 | 201080_at | PIP4K2B | ACAACTGTTCCCCAATCTAC | CAGCCATCTGCAGGGGTCAG |
| 866 | NNG9H9 | 201250_s_at | SLC2A1 | GATTGAGGGTAGGAGGTTTG | GATGGGAGTGAGACAGAAGT |
| 867 | PPG12H12 | 204126_s_at | CDC45L | CTGAAAGCTGAGGATCGGAG | CAAGTTTCTGGACGCACTTA |
| 868 | MMA9B9 | 202220_at | KIAA0907 | TCTCCCAGAACTGGTTGCAG | CTAAAACAGAGAGATCTGAC |
| 869 | SSE3F3 | 218742_at | NARFL | GAGCAAGACGGGTTCTCACC | CCTGACTTCTGGAGGCTTCC |
| 870 | QA2B2 | 208424_s_at | CIAPIN1 | CCCACTTTAGAAGAGTCCAG | GTTGGTGAGCATTTAGAGGG |
| 871 | SSC5D5 | 212644_s_at | MAPK1IP1L | TTAGGGAACCTTAAGTCATG | CAGACATGACTGTTCTCTTT |
| 872 | YYA1B1 | 205480_s_at | UGP2 | AGCGGGAATTTCCTACAGTG | CCCTTGGTTAAATTAGGCAG |
| 873 | ZG1H1 | 203499_at | EPHA2 | AGTCGGCCCCATCTCTCATC | CTTTTGGATAAGTTTCTATT |
| 874 | GGGE7F7 | 204949_at | ICAM3 | CATAATGGTACTTATCAGTG | CCAAGCGTCCAGCTCACGAG |
| 875 | LLLG3H3 | 219654_at | PTPLA | GTGTGGTGCTTTTTCTGGTC | GCGTGGACTGTGACAGAGAT |
| 876 | ZE6F6 | 215093_at | NSDHL | CACCCTACTCTTTCCGTGAC | GATGAGGGCGGCAAAAACAG |
| 877 | QQE2F2 | 204826_at | CCNF | GGGTGAGAACCCAAGCGTTG | GAACTGTAGACCCGTCCTGT |
| 878 | ZE12F12 | 201756_at | RPA2 | GAGAAACCTGCTGGCCTCTG | CCTGTTTTCATTTCCCACTT |
| 879 | OA2B2 | 202678_at | GTF2A2 | AGGCTATAAATGCAGCACTG | GCTCAGAGGGTCAGGAACAG |
| 880 | NC1D1 | 221230_s_at | ARID4B | TCTTTGTTTCCTGGCAATAC | GACGTGGGAATTTCAATGCG |
| 881 | JJA1B1 | 203155_at | SETDB1 | TGATCCCTTCCAATGTGGTG | CTAGCAGGCAGGATCCCTTC |
| 882 | JJC10D10 | 212458_at | SPRED2 | CCGACCCCCAAGCTATTTG | CTCACATTAACAAATTAAAG |
| 883 | OG8H8 | 213153_at | SETD1B | GAGTTTTAGGGATGTTTGTG | CGGGTAGACTCCATCATCCA |
| 884 | LLLG2H2 | 208690_s_at | PDLIM1 | TGAGTCCCCTCCCTGCCTTG | GTTAATTGACTCACACCAGC |
| 885 | SA8B8 | 218102_at | DERA | TGCCCTAGCAGAGGAAAATG | CAACATCTCGCAAGCGCTGC |
| 886 | AAAC7D7 | 211919_s_at | CXCR4 | CCGACTTCATCTTTGCCAAC | GTCAGTGAGGCAGATGACAG |
| 887 | TG4H4 | 203343_at | UGDH | TGCTGAGAATGTACAGTTTG | CATTAAACATCCCAGGTCTC |
| 888 | QG5H5 | 203464_s_at | EPN2 | GCTGTTTCTCAGTCCCAGAG | GCCGGTGGCTGGTTTTGAAC |
| 889 | QQG3H3 | 205173_x_at | CD58 | CCAAGCAGCGGTCATTCAAG | ACACAGATATGCACTTATAC |
| 890 | YYE2F2 | 212399_s_at | VGLL4 | TGCCTGCAGTGCGCTCTGAC | CTTCTCTTCATGTGTGTAAA |
| 891 | RRA7B7 | 221552_at | ABHD6 | TGTTCTGAGTGAACCCACAG | CAGTCGCAGAATGAGCACCT |
| 892 | NNE7F7 | 220127_s_at | FBXL12 | GGGCACCTGAGGGTCTGAGC | CCCCTTATGAGTACCCAAGA |
| 893 | MMG5H5 | 217873_at | CAB39 | AGGTCGTAGCCTTTTAGGTG | GAAGAAGTGAGGGTGCAGCG |

TABLE 3-continued

Representative Cluster Centroid Landmark Transcripts/Probe Pairs Validated for LMF (SEQ ID NOS 171-2, 170, respectively, in order of appearance)

| ## | name | Affymetrix | gene symbol | left probe sequence | right probe sequence |
|---|---|---|---|---|---|
| 894 | QE2F2 | 203342_at | TIMM17B | CGAAGTTCTCACCCCAGCTC | CTTTGTGTGGCACCCTGATG |
| 895 | PA12B12 | 201697_s_at | DNMT1 | ACATGGTGTTTGTGGCCTTG | GCTGACATGAAGCTGTTGTG |
| 896 | RRC5D5 | 221887_s_at | DFNB31 | CCTCCAGCTAGGACCCAGCC | CATCCCCAGATGCCTGAGCC |
| 897 | OOC11D11 | 201608_s_at | PWP1 | AGTGGCCCTTTTGGCAGCAG | GAGCTCAGATACACCCATGG |
| 898 | QQG12H12 | 217168_s_at | HERPUD1 | GCTGTTGGAGGCTTTGACAG | GAATGGACTGGATCACCTGA |
| 899 | MG2H2 | 201847_at | LIPA | GGTTGCCCATGAGAAGTGTC | CTTGTTCATTTTCACCCAAA |
| 900 | KKKC12D12 | 221641_s_at | ACOT9 | ACTCTACCCACAGTGACGTG | GTATCTGATGAAGACCTGAT |
| 901 | LLC9D9 | 207871_s_at | ST7 | CTGTGGCACCAGCTAACACG | GATCTGAGAGAAGCCCTGTC |
| 902 | YC6D6 | 208407_s_at | CTNND1 | ACCACTGGGCCATAATGTTG | CTTCTCAGGCTATATGCAGT |
| 903 | LLC2D2 | 218581_at | ABHD4 | GGTGGTTCCCACTGCATGAC | CCTCTATCCCTGCCATCTGT |
| 904 | AAE4F4 | 201626_at | INSIG1 | ATTTCCAATGAAGATGTCAG | CATTTTATGAAAAACCAGAA |
| 905 | QE10F10 | 203989_x_at | ZNF160 | GAAGAGAGAGGCCAGGCGCG | GTGGCTCACACCTGTAATCC |
| 906 | NG6H6 | 202494_at | PPIE | TGGGCCTCTCCTGGGACTAC | CAGTGTGGCTCTTACGTGTT |
| 907 | ZA1B1 | 201628_s_at | RRAGA | AGTGGGCTTTGAAGTGTGTG | CTGCTTACTCCTTTCATCTT |
| 908 | ME5F5 | 207467_x_at | CAST | CTCCAAAGCACCTAAGAATG | GAGGTAAAGCGAAGGATTCA |
| 909 | IIA1B1 | 217911_s_at | BAG3 | TGCAGCCCTGTCTACTTGGG | CACCCCCACCACCTGTTAGC |
| 910 | NNC8D8 | 201040_at | GNAI2 | TGTCTTGTTCTGTGATGAGG | GGAGGGGGGCACATGCTGAG |
| 911 | MC5D5 | 203120_at | TP53BP2 | CCTGCCAGAAAGGACCAGTG | CCGTCACATCGCTGTCTCTG |
| 912 | SC5D5 | 202825_at | SLC25A4 | AACCAGACTGAAAGGAATAC | CTCAGAAGAGATGCTTCATT |
| 913 | YG11H11 | 201644_at | TSTA3 | GGGCAGTTTAAGAAGACAGC | CAGTAACAGCAAGCTGAGGA |
| 914 | VC8D8 | 202599_s_at | NRIP1 | TCCCATTGCAAACATTATTC | CAAGAGTATCCCAGTATTAG |
| 915 | IIIE4F4 | 215945_s_at | TRIM2 | CGCTGTGCATCAAAGTGTTT | GTATGTTCGTAGCTACATAC |
| 916 | NNC10D10 | 201397_at | PHGDH | GAGAAAATCCACATTCTTGG | GCTGAACGCGGGCCTCTGAC |
| 917 | MMMC7D7 | 209163_at | CYB561 | CCAGTCTCCTCTAATGCTCA | GATTTCCCATAGTTGGCTTT |
| 918 | RRG10H10 | 200895_s_at | FKBP4 | GGACATGGGAAAAACCACTG | CTATGCCATTTCTTCTCTCT |
| 919 | KKC2D2 | 200811_at | CIRBP | TGTGGCTTTTTCCAACTCC | GTGTGACGTTTCTGAGTGTA |
| 920 | QQG10H10 | 213110_s_at | COL4A5 | GAATCCTCCTGTGGCCTCTG | CTTGTACAGAACTGGGAAAC |
| 921 | SSE1F1 | 202009_at | TWF2 | CGGGCTGGCATTTTGTGACC | CTTCCCTGTTGCTGTCCCTG |
| 922 | HHG7H7 | 202123_s_at | ABL1 | CTGTGGTGGCTCCCCCTCTG | CTTCTCGGGGTCCAGTGCAT |
| 923 | IIA10B10 | 201743_at | CD14 | CTGACGAGCTGCCCGAGGTG | GATAACCTGACACTGGACGG |
| 924 | AAA8B8 | 203494_s_at | CEP57 | AAGTGAGAAACAGTGCTCTG | GTGACATGATAAATATATGT |
| 925 | SSC6D6 | 221856_s_at | FAM63A | GTTTCTGGTTCTCAACTCCC | GGTCCCTGAATAGTCACACG |
| 926 | UUA1B1 | 218695_at | EXOSC4 | GGCAGATGGTGGGACCTATG | CAGCTTGTGTGAATGCAGCC |
| 927 | NNA10B10 | 201323_at | EBNA1BP2 | GAAAGGGTCAAATAAGAGAC | CTGGAAAACGAACAAGAGAG |
| 928 | GGGE2F2 | 203358_s_at | EZH2 | TCGAAAGAGAAATGGAAATC | CCTTGACATCTGCTACCTCC |
| 929 | KKG12H12 | 207515_s_at | POLR1C | AAGCTAAAGAAGGTTGTGAG | GCTTGCCCGGGTTCGAGATC |
| 930 | PPC5D5 | 202726_at | LIG1 | CCCTCGGTTTATTCGAGTCC | GTGAAGACAAGCAGCCGGAG |
| 931 | LG1H1 | 212875_s_at | C2CD2 | CGGAAAGGTTTGGCCTGACG | CTGGAGTGCGGTGATGAACT |

TABLE 3-continued

Representative Cluster Centroid Landmark Transcripts/Probe Pairs Validated for LMF (SEQ ID NOS 171-2, 170, respectively, in order of appearance)

| ## | name | Affymetrix | gene symbol | left probe sequence | right probe sequence |
|---|---|---|---|---|---|
| 932 | XG3H3 | 218093_s_at | ANKRD10 | TGGATTTATTGTTTTTATTC | CACACTTCCTACTTGGTCTC |
| 933 | QC10D10 | 207059_at | DDX41 | CTGGCTGCCTGTTCCCTGTG | CTCTTCAGAATTACTGTTTT |
| 934 | KKG4H4 | 218421_at | CERK | AAGTCTGAGTGAAAGGATGG | CCTCATTCTCTTTCTAATCT |
| 935 | QC4D4 | 209380_s_at | ABCC5 | AGACCTACCTCAGGTTGCTG | GTTGCTGTGTGGTTTGGTGT |
| 936 | LLG9H9 | 202963_at | RFX5 | GTTCTGTGGTCAGGCGGCAC | CAATGAGAAAGGAATGCAGA |
| 937 | QE12F12 | 201944_at | HEXB | AGCTGCACAACCTCTTTATG | CTGGATATTGTAACCATGAG |
| 938 | ZA2B2 | 200915_x_at | KTN1 | TAAACCAACAGCTCACAAAG | GAGAAAGAGCACTACCAGGT |
| 939 | KKE5F5 | 212403_at | UBE3B | CCCATCCTAATTTTTATCAC | CTGAAGGTTGGAACCAGTGA |
| 940 | EEEG5H5 | 205398_s_at | SMAD3 | TCAAAGAGATTCGAATGACG | GTAAGTGTTCTCATGAAGCA |
| 941 | HHA2B2 | 121_at | PAX8 | TGTGCTTCCTGCAGCTCACG | CCCACCAGCTACTGAAGGGA |
| 942 | HHE3F3 | 212300_at | TXLNA | CAGCTTTTTTGTCTCCTTTG | GGTATTCACAACAGCCAGGG |
| 943 | NNE8F8 | 201087_at | PXN | TCTCCACTTTCACCCGCAGG | CCTTACCGCTCTGTTTATAG |
| 944 | LLLE8F8 | 201136_at | PLP2 | CAACAACATTCCCAGCAGAC | CAACTCCCACCCCTCTTTG |
| 945 | HHHE5F5 | 212038_s_at | VDAC1 | TTCCCTAACCCTAATTGATG | AGAGGCTCGCTGCTTGATGG |
| 946 | XA11B11 | 209408_at | KIF2C | TTTAGTACAGCTATCTGCTG | GCTCTAAACCTTCTACGCCT |
| 947 | JJG2H2 | 204252_at | CDK2 | TGATCCCATTTTCCTCTGAC | GTCCACCTCCTACCCCATAG |
| 948 | RA12B12 | 204542_at | ST6GALNAC2 | TCCCATTAGAGATGTATCAC | CACCTTGTCACCAACAGGAT |
| 949 | KKE2F2 | 202114_at | SNX2 | GACCCTCTTTGAATTAAGTG | GACTGTGGCATGACATTCTG |
| 950 | FFG4H4 | 213152_s_at | SFRS2B | CATGCAGTGAGCACATCTAG | CTGACGATAATCACACCTTT |
| 951 | LLE3F3 | 212651_at | RHOBTB1 | GGCAGTGGAAACACCAGATA | GAAGATCTTAGGAGAGGCCC |
| 952 | YC8D8 | 202925_s_at | PLAGL2 | TAGCTGATTGTTCCCACTTG | CACCTCTCCACCTTTGGCAC |
| 953 | TC10D10 | 205324_s_at | FTSJ1 | ACAACCCTGAAGCAACAAG | GAAAGAAACCATGAAAGTCT |
| 954 | QQG7H7 | 208898_at | ATP6V1D | TCAGGCCAATTACTGTGGAG | CAGCTTTCATTCCTACCCAC |
| 955 | LLE1F1 | 218399_s_at | CDCA4 | TAGATCACAGGCACCAGTTG | GTCTTCAGGGACCTCATAGC |
| 956 | QQE3F3 | 205031_at | EFNB3 | TGGCCACCTCAATCACCAGC | CAAGATGGTTGCTTTGTCCA |
| 957 | NNC3D3 | 205691_at | SYNGR3 | GACACCAGCCCTGTCCTAGC | CCTTCAGTAAGACCTTGCCA |
| 958 | TTE10F10 | 221514_at | UTP14A | ATGCTCTGTAGATTGAGTTG | CTGGAGGAGTGACAGCCAGG |
| 959 | MC12D12 | 203675_at | NUCB2 | AACGTCAGCATGATCAACTG | GAGGCTCAGAAGCTGGAATA |
| 960 | TC7D7 | 202119_s_at | CPNE3 | GTAAATTCAGGGCCCCATTG | CTACTTATGCCATATTTGGA |
| 961 | OOG7H7 | 200783_s_at | STMN1 | TTCTCTGCCCCGTTTCTTGC | CCCAGTGTGGTTTGCATTGT |
| 962 | PPA3B3 | 202413_s_at | USP1 | CTTGATTCACTTAGAAGTGT | CTCAGAAAACCTGGACAGTT |
| 963 | FFA8B8 | 218140_x_at | SRPRB | GGTCTAGTGTGTTCTTAGTG | GTTATACTGGGAAGTGTGTG |
| 964 | MA7B7 | 219352_at | HERC6 | GGAATGTACTTTCACTTTTG | CTGCTTCACTGCCTTGTGCT |
| 965 | QQA10B10 | 212880_at | WDR7 | CAACCAAGGCCAGTAGAAAG | CTATGGCTGCAAAACCCTGG |
| 966 | ZZC7D7 | 200848_at | AHCYL1 | ATGAACTGAGATCATAAAGG | GCAACTGATGTGTGAAGAAA |
| 967 | UUA6B6 | 212536_at | ATP11B | ACCTGAGACACTGTGGCTGT | CTAATGTAATCCTTTAAAAA |
| 968 | TG10H10 | 204489_s_at | CD44 | GCCAACCTTTCCCCCACCAG | CTAAGGACATTTCCCAGGGT |
| 969 | MMC1D1 | 204781_s_at | FAS | AGAAAGTAGCTTTGTGACAT | GTCATGAACCCATGTTTGCA |

TABLE 3-continued

Representative Cluster Centroid Landmark Transcripts/Probe Pairs Validated for LMF (SEQ ID NOS 171-2, 170, respectively, in order of appearance)

| ## | name | Affymetrix | gene symbol | left probe sequence | right probe sequence |
|---|---|---|---|---|---|
| 970 | JJE5F5 | 205079_s_at | MPDZ | ACCCCTAGCTCACCTCCTAC | TGTAAAGAGAATGCACTGGT |
| 971 | QQA3B3 | 205046_at | CENPE | GGCAAGGATGTGCCTGAGTG | CAAAACTCAGTAGACTCCTC |
| 972 | TG1H1 | 206414_s_at | ASAP2 | GCATTTTGCATGCCATTCTC | CATCAGATCTGGGATGATGG |
| 973 | NNC2D2 | 204610_s_at | CCDC85B | CTAGCGCTTAAGGAGCTCTG | CCTGGCGCTGGGCGAAGAAT |
| 974 | NNA3B3 | 204756_at | MAP2K5 | GGCCATCCCCATACCTTCTG | GTTTGAAGGCGCTGACACTG |
| 975 | QC9D9 | 202318_s_at | SENP6 | GGACACTTACTCAACAGAAG | CACCTTTAGGCGAAGGAACA |
| 976 | HHHA11B11 | 218407_x_at | NENF | TTCTTGGGAGCGTGAGGCAG | GAAGACACTAGGTGCTGAAT |
| 977 | OOC5D5 | 213190_at | COG7 | TTACTGACCCCACCACACAC | CGGACCACCAAGAGAGCCAG |
| 978 | XG9H9 | 203576_at | BCAT2 | GCCAGCACTCGCCTCCCTAC | CAATGACTCACCTGAAGTGC |
| 979 | OE3F3 | 201827_at | SMARCD2 | GTTTTCAGGGAGCCTGTTAG | GTGCCTCCTTCTTTTCTTTC |
| 980 | IIG12H12 | 203067_at | PDHX | TGGCCATTAACTTAGCAGTG | GGACCTCACTTTTACAAGCA |
| 981 | OOA6B6 | 221560_at | MARK4 | AAAGAAGAGGCGTGGGAATC | CAGGCAGTGGTTTTTCCTTT |
| 982 | UA5B5 | 212737_at | GM2A | GTGGCCTCGACATCAAACTG | CCTGGATTTTTCTACCACCC |
| 983 | AAAG6H6 | 204925_at | CTNS | CCAGGACGTGCCTCATACAT | GACTTGAGCTTGTCAGTCCA |
| 984 | OA11B11 | 212717_at | PLEKHM1 | GTCTTTGCAATGTATTGAAG | GAATTGCTGCCGTGTGAGTT |
| 985 | IIG8H8 | 201200_at | CREG1 | TTCAGCCAGGGACAAAATCC | CCTCCCAAACCACTCTCCAC |
| 986 | MA6B6 | 209603_at | GATA3 | GCTACCAGCGTGCATGTCAG | CGACCCTGGCCCGACAGGCC |
| 987 | CCCE3F3 | 219061_s_at | LAGE3 | CTGGAAAGCTGAAGACTGTC | GCCTGCTCCGAATTTCCGTC |
| 988 | CCCA2B2 | 204679_at | KCNK1 | TAGGAGGAGAATACTTGAAG | CAGTATGCTGCTGTGGTTAG |
| 989 | XC11D11 | 201931_at | ETFA | GCTTTGTTCCCAATGACATG | CAAGTTGGACAGACGGGAAA |
| 990 | ZC1D1 | 202398_at | AP3S2 | CACTGCTCAATACAGCCTCC | GATCCTCACTCTTGAAAGCT |
| 991 | WE4F4 | 209307_at | SWAP70 | TCACATGTGGACCTTGATAC | GACTAAGCGGTTACATATGT |
| 992 | BBBA9B9 | 205919_at | HBE1 | TGGCTACTCACTTTGGCAAG | GAGTTCACCCCTGAAGTGCA |
| 993 | YYG8H8 | 208290_s_at | EIF5 | TGGAGTGTGTGGTAGCAATG | CATCAAGCTCAGCTTATCTC |
| 994 | NC4D4 | 218679_s_at | VPS28 | CAACTCACTGTCTGCAGCTG | CCTGTCTGGTGTCTGTCTTT |
| 995 | OOA12B12 | 201788_at | DDX42 | GCTCTGAAGATTCCCAGAAG | CCACAAGGATTGAAGGGAAA |
| 996 | ZC3D3 | 218149_s_at | ZNF395 | GACGTCTGTGGCCAAGCGAG | GTCTCAGGTGCAAAGCAAAA |
| 997 | BBBG3H3 | 211330_s_at | HFE | TCGTCTGAAAGAGGAAGCAG | CTATGAAGGCCAAAACAGAG |
| 998 | FFFG2H2 | 208763_s_at | TSC22D3 | AACCAGCCTTGGGAGTATTG | ACTGGTCCCTTACCTCTTAT |
| 999 | TA3B3 | 203232_s_at | ATXN1 | GCACTACCAGACTGACATGG | CCAGTACAGAGGAGAACTAG |
| 1000 | TA9B9 | 202655_at | ARMET | CTGGAGCTTTCCTGATGATG | CTGGCCCTACAGTACCCCCA |

The invention is further described by the following numbered paragraphs:

1. A method for making a transcriptome-wide mRNA-expression profiling platform using sub-transcriptome numbers of transcript measurements comprising:
a) providing:
i) a first library of transcriptome-wide mRNA-expression data from a first collection of biological samples;
ii) a second collection of biological samples;
iii) a second library of transcriptome-wide mRNA-expression data from said second collection of biological samples;
iv) a device capable of measuring transcript expression levels;
b) performing computational analysis on said first library such that a plurality of transcript clusters are created, wherein the number of said clusters is substantially less than the total number of all transcripts;
c) identifying a centroid transcript within each of said plurality of transcript clusters, thereby creating a plurality of centroid transcripts, said remaining transcripts being non-centroid transcripts;

d) measuring the expression levels of at least a portion of transcripts from said second collection of biological samples with said device, wherein said portion of transcripts comprise transcripts identified as said centroid transcripts from said first library;

e) determining the ability of said measurements of the expression levels of said centroid transcripts to infer the levels of at least a portion of transcripts from said second library, wherein said portion is comprised of non-centroid transcripts;

f) selecting said centroid transcripts whose said expression levels have said ability to infer the levels of said portion of non-centroid transcripts.

2. The method of Paragraph 1, wherein said plurality of centroid transcripts is approximately 1000 centroid transcripts.

3. The method of Paragraph 1, wherein said device is selected from the group consisting of a microarray, a bead array, a liquid array, and a nucleic-acid sequencer.

4. The method of Paragraph 1, wherein said computational analysis comprises cluster analysis.

5. The method of Paragraph 1, wherein said method further comprises repeating steps c) to f) until validated centroid transcripts for each of said plurality of transcript clusters are identified.

6. The method of Paragraph 1, wherein said plurality of clusters of transcripts are orthogonal.

7. The method of Paragraph 1, wherein said plurality of clusters of transcripts are non-overlapping.

8. The method of Paragraph 1, wherein said determining involves a correlation between said expression levels of said centroid transcripts and said expression levels of said non-centroid transcripts.

9. The method of Paragraph 1, wherein expression levels of a set of substantially invariant transcripts are additionally measured with said device in said second collection of biological samples.

10. The method of Paragraph 9, wherein said measurements of said centroid transcripts made with said device, and said mRNA-expression data from said first and second libraries, are normalized with respect to the expression levels of a set of substantially invariant transcripts.

11. A method for identifying a subpopulation of predictive transcripts within a transcriptome, comprising:

a) providing:
i) a first library of transcriptome-wide mRNA-expression data from a first collection of biological samples;
ii) a second collection of biological samples;
ii) a second library of transcriptome-wide mRNA-expression data from said second collection of biological samples;
iii) a device capable of measuring transcript expression levels;

b) performing computational analysis on said first library such that a plurality of transcript clusters are created, wherein the number of said clusters is less than the total number of all transcripts in said first library;

c) identifying a centroid transcript within each of said transcript clusters thereby creating a plurality of centroid transcripts, said remaining transcripts being non-centroid transcripts;

d) processing transcripts from said second collection of biological samples on said device so as to measure expression levels of said centroid transcripts, and e) determining which of said plurality of centroid transcripts measured on said device predict the levels of said non-centroid transcripts in said second library of transcriptome-wide data.

12. The method of Paragraph 11, wherein said plurality of centroid transcripts is approximately 1000 centroid transcripts.

13. The method of Paragraph 11, wherein said device is selected from the group consisting of a microarray, a bead array, a liquid array, and a nucleic-acid sequencer.

14. The method of Paragraph 11, wherein said computational analysis comprises cluster analysis.

15. The method of Paragraph 11, wherein said determining involves a correlation between said centroid transcript and said non-centroid transcript.

16. The method of Paragraph 11, wherein said method further comprises repeating steps c) to e).

17. A method for identifying a subpopulation of approximately 1000 predictive transcripts within a transcriptome, comprising:

a) providing:
i) a first library of transcriptome-wide mRNA-expression data from a first collection of biological samples representing greater than 1000 different transcripts, and
ii) transcripts from a second collection of biological samples;

b) performing computational analysis on said first library such that a plurality of clusters of transcripts are created, wherein the number of said clusters is approximately 1000 and less than the total number of all transcripts in said first library;

c) identifying a centroid transcript within each of said transcript clusters, said remaining transcripts being non-centroid transcripts;

d) processing the transcripts from said second collection of biological samples so as to measure the expression levels of non-centroid transcripts, so as to create first measurements, and expression levels of centroid transcripts, so as to create second measurements; and e) determining which centroid transcripts based on said second measurements predict the levels of said non-centroid transcripts, based on said first measurements, thereby identifying a subpopulation of predictive transcripts within a transcriptome.

18. The method of Paragraph 17, wherein said method further comprises a device capable of measuring the expression levels of said centroid transcripts.

19. The method of Paragraph 18, wherein said device is capable of measuring the expression levels of approximately 1000 of said centroid transcripts.

20. The method of Paragraph 17, wherein said computational analysis comprises cluster analysis.

21. The method of Paragraph 17, wherein said determining involves a correlation between said centroid transcript and said non-centroid transcript.

22. The method of Paragraph 17, wherein said method further comprises repeating steps c) to e).

23. A method for predicting the expression level of a first population of transcripts by measuring the expression level of a second population of transcripts, comprising:

a) providing:
i) a first heterogeneous population of transcripts comprising a second heterogeneous population of transcripts, said second population comprising a subset of said first population,
ii) an algorithm capable of predicting the level of expression of transcripts within said first population which are not within said second population, said predicting based on the measured level of expression of transcripts within said second population;

b) processing said first heterogeneous population of transcripts under conditions such that a plurality of different templates representing only said second population of transcripts is created;

c) measuring the amount of each of said different templates to create a plurality of measurements; and d) applying said algorithm to said plurality of measurements, thereby predicting the level of expression of transcripts within said first population which are not within said second population.

24. The method of Paragraph 23, wherein said first heterogenous population of transcripts comprise a plurality of non-centroid transcripts.

25. The method of Paragraph 23, wherein said second heterogenous population of transcripts comprises a plurality of centroid transcripts.

26. The method of Paragraph 23, wherein said method further comprises a device capable of measuring the amount of approximately 1000 of said different templates.

27. The method of Paragraph 26, wherein said device is selected from the group consisting of a microarray, a bead array, a liquid array, and a nucleic-acid sequencer.

28. The method of Paragraph 23, wherein said algorithm involves a dependency matrix.

29. A method of assaying gene expression, comprising:
a) providing:
i) approximately 1000 different barcode sequences;
ii) approximately 1000 beads, each bead comprising a homogeneous set of nucleic-acid probes, each set complementary to a different barcode sequence of said approximately 1000 barcode sequences;
iii) a population of more than 1000 different transcripts, each transcript comprising a gene-specific sequence;
iv) an algorithm capable of predicting the level of expression of unmeasured transcripts;
b) processing said population of transcripts to create approximately 1000 different templates, each template comprising one of said approximately 1000 barcode sequences operably associated with a different gene-specific sequence, wherein said approximately 1000 different templates represents less than the total number of transcripts within said population;
c) measuring the amount of each of said approximately 1000 different templates to create a plurality of measurements; and
d) applying said algorithm to said plurality of measurements, thereby predicting the level of expression of unmeasured transcripts within said population.

30. The method of Paragraph 29, wherein said method further comprises a device capable of measuring the amount of each of said approximately 1000 different templates.

31. The method of Paragraph 29, wherein said beads are optically addressed.

32. The method of Paragraph 29, wherein said processing comprises ligation-mediated amplification.

33. The method of Paragraph 31, wherein said measuring comprises detecting said optically addressed beads.

34. The method of Paragraph 31, wherein said measuring comprises hybridizing said approximately 1000 different templates to said approximately 1000 beads through said nucleic-acid probes complementary to said approximately 1000 barcode sequences.

35. The method of Paragraph 31, wherein said measuring comprises a flow cytometer.

36. The method of Paragraph 29, wherein said algorithm involves a dependency matrix.

37. A composition comprising an amplified nucleic acid sequence, wherein said sequence comprises at least a portion of a cluster centroid transcript sequence and a barcode sequence, wherein said composition further comprises an optically addressed bead, and wherein said bead comprises a capture probe nucleic-acid sequence hybridized to said barcode.

38. The composition of Paragraph 37, wherein said barcode sequence is at least partially complementary to said capture probe nucleic acid.

39. The composition of Paragraph 37, wherein said amplified nucleic-acid sequence is biotinylated.

40. The composition of Paragraph 37, wherein said optically addressable bead is detectable with a flow cytometric system.

41. The composition of Paragraph 40, wherein said flow cytometric system discriminates between approximately 500-1000 optically addressed beads.

42. A method for creating a genome-wide expression profile, comprising:
a) providing:
i) a plurality of genomic transcripts derived from a biological sample;
ii) a plurality of centroid transcripts comprising at least a portion of said genomic transcripts, said remaining genomic transcripts being non-centroid transcripts;
b) measuring the expression level of said plurality of centroid transcripts;
c) inferring the expression levels of said non-centroid transcripts from said centroid transcript expression levels, thereby creating a genome-wide expression profile.

43. The method of Paragraph 42, wherein said plurality of centroid transcripts comprise approximately 1,000 transcripts.

44. The method of Paragraph 42, wherein said measuring comprises a device selected from the group consisting of a microarray, a bead array, a liquid array, and a nucleic-acid sequencer.

45. The method of Paragraph 42, wherein said inferring involves a dependency matrix.

46. The method of Paragraph 42, wherein said genome-wide expression profile identifies said biological sample as diseased.

47. The method of Paragraph 42, wherein said genome-wide expression profile identifies said biological sample as healthy.

48. The method of Paragraph 42, wherein said genome-wide expression profile provides a functional readout of the action of a perturbagen.

49. The method of Paragraph 42, wherein said genome-wide expression profile comprises an expression profile suitable for use in a connectivity map.

50. The method of Paragraph 49, wherein said expression profile is compared with query signatures for similarities.

51. The method of Paragraph 42, wherein said genome-wide expression profile comprises a query signature compatible with a connectivity map.

52. The method of Paragraph 51, wherein said query signature is compared with known genome-wide expression profiles for similarities.

53. A kit, comprising:
a) a first container comprising a plurality of centroid transcripts derived from a transcriptome;
b) a second container comprising buffers and reagents compatible with measuring the expression level of said plurality of centroid transcripts within a biological sample;
c) a set of instructions for inferring the expression level of non-centroid transcripts within said biological sample, based upon the expression level of said plurality of centroid transcripts.

54. The kit of Paragraph 53, wherein said plurality of centroid transcripts is approximately 1,000 transcripts.

55. A method for making a transcriptome-wide mRNA-expression profile, comprising:
a) providing:
i) a composition of validated centroid transcripts numbering substantially less than the total number of all transcripts;
ii) a device capable of measuring the expression levels of said validated centroid transcripts;
iii) an algorithm capable of substantially calculating the expression levels of transcripts not amongst the set of said validated centroid transcripts from expression levels of said validated centroid transcripts measured by said device and transcript cluster information created from a library of transcriptome-wide mRNA-expression data from a collection of biological samples; and
iv) a biological sample;
b) applying said biological sample to said device whereby expression levels of said validated centroid transcripts in said biological sample are measured;
c) applying said algorithm to said measurements thereby creating a transcriptome-wide mRNA expression profile.

56. The method of Paragraph 55, wherein said validated centroid transcripts comprise approximately 1,000 transcripts.

57. The method of Paragraph 55, wherein said device is selected from the group consisting of a microarray, a bead array, a liquid array, and a nucleic-acid sequencer.

58. The method of Paragraph 55, wherein expression levels of a set of substantially invariant transcripts are additionally measured in said biological sample.

59. The method of Paragraph 55, wherein said expression levels of said validated centroid transcripts are normalized with respect to said expression levels of said invariant transcripts.

101. A method, comprising:
a) providing:
i) a sample comprising a plurality of analytes;
ii) a plurality of solid substrate populations, wherein each of said solid substrate populations comprise a plurality of subsets, and wherein each subset is present in an unequal proportion from every other subset in the same solid substrate population;
iii) a plurality of capture probes capable of attaching to said plurality of analytes, wherein each subset comprises a different capture probe; and
vi) a means for detecting said plurality of subsets that is capable of creating a multimodal intensity distribution pattern;
b) detecting said plurality of subsets with said means, wherein a multimodal intensity distribution pattern is created;
c) identifying said plurality of analytes from said multimodal distribution pattern.

102. The method of Paragraph 101, wherein said sample may be selected from the group comprising a biological sample, a soil sample, or a water sample.

103. The method of Paragraph 101, wherein said plurality of analytes may be selected from the group comprising nucleic acids, proteins, peptides, biological receptors, enzymes, antibodies, polyclonal antibodies, monoclonal antibodies, or Fab fragments.

104. The method of Paragraph 101, wherein said solid substrate population comprises a bead-set population.

105. The method of Paragraph 101, wherein said unequal proportions comprise two subsets in an approximate ratio of 1.25:0.75.

106. The method of Paragraph 101, wherein said unequal proportions comprise three subsets in an approximate ratio of 1.25:1.00:0.75.

107. The method of Paragraph 101, wherein said unequal proportions comprise four subsets in an approximate ratio of 1.25:1.00:0.75:0.50.

108. The method of Paragraph 101, wherein said unequal proportions comprise five subsets in an approximate ratio of 1.50:1.25:1.00:0.75:0.50.

109. The method of Paragraph 101, wherein said unequal proportions comprise six subsets in an approximate ratio of 1.75:1.50:1.25:1.00:0.75:0.50.

110. The method of Paragraph 101, wherein said unequal proportions comprise seven subsets in an approximate ratio of 2.00:1.75:1.50:1.25:1.00:0.75:0.50.

111. The method of Paragraph 101, wherein said unequal proportions comprise eight subsets in an approximate ratio of 2.00:1.75:1.50:1.25:1.00:0.75:0.50:0.25.

112. The method of Paragraph 101, wherein said unequal proportions comprise nine subsets in an approximate ratio of 2.25:2.00:1.75:1.50:1.25:1.00:0.75:0.50:0.25.

113. The method of Paragraph 101, wherein said unequal proportions comprise ten subsets in an approximate ratio of 2.50:2.25:2.00:1.75:1.50:1.25:1.00:0.75:0.50:0.25.

114. A method, comprising:
a) providing;
i) a solid substrate population comprising a first subset and a second subset, wherein the first subset is present in a first proportion and the second subset is present in a second proportion;
ii) a first analyte attached to said first subset;
iii) a second analyte attached to said second subset; and
vi) a means for detecting said first subset and second subset that is capable of creating a multimodal intensity distribution pattern;

b) detecting said first subset and said second subset with said means, wherein a multimodal intensity distribution pattern is created; and c) identifying said first analyte and said second analyte from said multimodal distribution pattern.

115. The method of Paragraph 114, wherein said solid substrate population comprises a label.

116. The method of Paragraph 115, wherein said label comprises a mixture of at least two different fluorophores.

117. The method of Paragraph 114, wherein said first proportion is different from said second proportion.

118. The method of Paragraph 114, wherein said first analyte is attached to said first subset with a first capture probe.

119. The method of Paragraph 114, wherein said second analyte is attached to said second subset with a second capture probe.

120. The method of Paragraph 114, wherein said multimodal intensity distribution pattern comprises a first peak corresponding to said first subset.

121. The method of Paragraph 114, wherein said multimodal intensity distribution pattern comprises a second peak corresponding to said second subset.

122. A method, comprising:
a) providing:
i) a solid substrate population comprising a plurality of subsets;
ii) a sample comprising a plurality of analytes, wherein at least one portion of said plurality of analytes comprise related analytes; and
iii) a means for detecting said subsets that is capable of creating a multimodal intensity distribution pattern;
b) attaching each of said related analyte portions to one of said plurality of subsets;
c) detecting said plurality of subsets with said means, wherein a multimodal intensity distribution pattern is created; and
d) identifying said related analytes from said multimodal distribution pattern.

123. The method of Paragraph 122, wherein said related analytes comprise linked genes.

124. A method, comprising:
a) providing:
i) a solid substrate population comprising a plurality of subsets;
ii) a sample comprising a plurality of analytes, wherein at least one portion of the plurality of analytes comprise rare event analytes; and
iii) a means for detecting said subsets that is capable of creating a multimodal intensity distribution pattern;
b) attaching a portion of said plurality of analytes comprising one or more of the rare event analytes to one of the plurality of subsets;
c) detecting said plurality of subsets with said means, wherein a multimodal intensity distribution pattern is created; and
d) determining if said rare event analytes occur in said multimodal distribution pattern.

125. The method of Paragraph 124, wherein said rare event analyte portion is present in approximately less than 0.01% of said sample.

126. The method of Paragraph 124, wherein said rare event analyte comprises a small molecule or drug.

127. The method of Paragraph 124, wherein said rare event analyte comprises a nucleic acid mutation.

128. The method of Paragraph 124, wherein said rare event analyte comprises a diseased cell.

129. The method of Paragraph 124, wherein said rare event analyte comprises an autoimmune antibody.

130. The method of Paragraph 124, wherein said rare event analyte comprises a microbe.

131. A method, comprising:
a) providing:
i) a solid substrate population comprising a plurality of subsets;
ii) a sample comprising a first labeled analyte and a second labeled analyte; and
iii) a means for detecting said subsets that is capable of creating a multimodal intensity distribution pattern;
b) attaching said first and second labeled analytes in an unequal proportion to one of said plurality of subsets;
c) detecting said plurality of subsets with said means, wherein a multimodal intensity distribution pattern is created; and
d) identifying said first and second labeled analytes from said multimodal distribution pattern.

132. The method of Paragraph 131, wherein said first labeled analyte comprises a normal cell.

133. The method of Paragraph 131, wherein said second labeled analyte comprises a tumor cell.

134. The method of Paragraph 131, wherein said multimodal intensity distribution pattern comprises a first peak corresponding to said first labeled analyte.

135. The method of Paragraph 131, wherein said multimodal intensity distribution pattern comprises a second peak corresponding to said second labeled analyte.

136. The method of Paragraph 131, wherein said unequal proportion is equivalent to a ratio of said first and second peaks.

Having thus described in detail preferred embodiments of the present invention, it is to be understood that the invention defined by the above paragraphs is not to be limited to particular details set forth in the above description as many apparent variations thereof are possible without departing from the spirit or scope of the present invention.

SEQUENCE LISTING (2170 sequences)

SEQ ID NO: 1 - DNA, 20 bp, Artificial Sequence
  Description of Artificial Sequence: Synthetic probe
ccatcaagaggctgaccttg

SEQ ID NO: 2 - DNA, 20 bp, Artificial Sequence
  Description of Artificial Sequence: Synthetic probe
cagcagaaggccaaggtgaa

SEQ ID NO: 3 - DNA, 20 bp, Artificial Sequence
  Description of Artificial Sequence: Synthetic probe
ggcgatgaggatgcgtctcg

SEQ ID NO: 4 - DNA, 20 bp, Artificial Sequence
  Description of Artificial Sequence: Synthetic probe
catggaagaagtcgattagg

SEQ ID NO: 5 - DNA, 20 bp, Artificial Sequence
  Description of Artificial Sequence: Synthetic probe
gaaaatcctatttatgaatc

SEQ ID NO: 6 - DNA, 20 bp, Artificial Sequence
  Description of Artificial Sequence: Synthetic probe
ctgtcggtattccttggtat

SEQ ID NO: 7 - DNA, 20 bp, Artificial Sequence
  Description of Artificial Sequence: Synthetic probe
tgctggaagccctcaccaag

SEQ ID NO: 8 - DNA, 20 bp, Artificial Sequence
  Description of Artificial Sequence: Synthetic probe
cacttccaggactgaccaga

SEQ ID NO: 9 - DNA, 20 bp, Artificial Sequence
  Description of Artificial Sequence: Synthetic probe
gtgtcagatgaagggaggtg

SEQ ID NO: 10 - DNA, 20 bp, Artificial Sequence
  Description of Artificial Sequence: Synthetic probe
gagttatcctcttatagtac

SEQ ID NO: 11 - DNA, 20 bp, Artificial Sequence
  Description of Artificial Sequence: Synthetic probe
ttctcttggccaggggcctc

SEQ ID NO: 12 - DNA, 20 bp, Artificial Sequence
  Description of Artificial Sequence: Synthetic probe
gtatcctacctttccttgtc

SEQ ID NO: 13 - DNA, 20 bp, Artificial Sequence
  Description of Artificial Sequence: Synthetic probe
tcttgtatctcccaggattc

SEQ ID NO: 14 - DNA, 20 bp, Artificial Sequence
  Description of Artificial Sequence: Synthetic probe
ctgttgctttacccacaaca

SEQ ID NO: 15 - DNA, 20 bp, Artificial Sequence
  Description of Artificial Sequence: Synthetic probe
cacgtcaggagaccacaaag

SEQ ID NO: 16 - DNA, 20 bp, Artificial Sequence
  Description of Artificial Sequence: Synthetic probe
cgaaagtattttgtgtccaa

SEQ ID NO: 17 - DNA, 20 bp, Artificial Sequence
  Description of Artificial Sequence: Synthetic probe
caggggaaggatgtactttc

SEQ ID NO: 18 - DNA, 20 bp, Artificial Sequence
  Description of Artificial Sequence: Synthetic probe
caaacaaatgatacaaccct

SEQ ID NO: 19 - DNA, 20 bp, Artificial Sequence
  Description of Artificial Sequence: Synthetic probe
aaagttagagcagtcagaag

SEQ ID NO: 20 - DNA, 20 bp, Artificial Sequence
  Description of Artificial Sequence: Synthetic probe
cccagctgggacgagggagt

SEQ ID NO: 21 - DNA, 20 bp, Artificial Sequence
  Description of Artificial Sequence: Synthetic probe
aatgacagacatgacatctg

SEQ ID NO: 22 - DNA, 20 bp, Artificial Sequence
  Description of Artificial Sequence: Synthetic probe
gcttgatggggcatagccag

SEQ ID NO: 23 - DNA, 20 bp, Artificial Sequence
  Description of Artificial Sequence: Synthetic probe
ttatctgctgggaaagtgtc

SEQ ID NO: 24 - DNA, 20 bp, Artificial Sequence
  Description of Artificial Sequence: Synthetic probe
caagagcctgtttttgaaac

SEQ ID NO: 25 - DNA, 20 bp, Artificial Sequence
  Description of Artificial Sequence: Synthetic probe
taacctggacggctctaagg

SEQ ID NO: 26 - DNA, 20 bp, Artificial Sequence
  Description of Artificial Sequence: Synthetic probe
ctggaatgaccacataggta

SEQ ID NO: 27 - DNA, 20 bp, Artificial Sequence
  Description of Artificial Sequence: Synthetic probe
atgtttacaggggttgtggg

SEQ ID NO: 28 - DNA, 20 bp, Artificial Sequence
  Description of Artificial Sequence: Synthetic probe
ggcagagggggtctgtgaat

SEQ ID NO: 29 - DNA, 20 bp, Artificial Sequence
  Description of Artificial Sequence: Synthetic probe
ggcaggcgcaaatgatttgg

SEQ ID NO: 30 - DNA, 20 bp, Artificial Sequence
  Description of Artificial Sequence: Synthetic probe
cgattcgagtggctgcagta

SEQ ID NO: 31 - DNA, 20 bp, Artificial Sequence
  Description of Artificial Sequence: Synthetic probe
acttagtttttgcacataac

SEQ ID NO: 32 - DNA, 20 bp, Artificial Sequence
  Description of Artificial Sequence: Synthetic probe
cttgtacaatcttgcaacag

SEQ ID NO: 33 - DNA, 20 bp, Artificial Sequence
  Description of Artificial Sequence: Synthetic probe
agctctgggagcagaggtgg

SEQ ID NO: 34 - DNA, 20 bp, Artificial Sequence
  Description of Artificial Sequence: Synthetic probe
ccctcggtgccgtcctgcgc

SEQ ID NO: 35 - DNA, 20 bp, Artificial Sequence
  Description of Artificial Sequence: Synthetic probe
ttgttcttcctggacctggg

SEQ ID NO: 36 - DNA, 20 bp, Artificial Sequence
  Description of Artificial Sequence: Synthetic probe
cattcagcctcctgctctta

SEQ ID NO: 37 - DNA, 20 bp, Artificial Sequence
  Description of Artificial Sequence: Synthetic probe
cgactgcctgtctccatgag

SEQ ID NO: 38 - DNA, 20 bp, Artificial Sequence
  Description of Artificial Sequence: Synthetic probe
gtactggtcccttccttttg

SEQ ID NO: 39 - DNA, 20 bp, Artificial Sequence
  Description of Artificial Sequence: Synthetic probe
cacggaaacagaactcgatg

SEQ ID NO: 40 - DNA, 20 bp, Artificial Sequence
  Description of Artificial Sequence: Synthetic probe
cactgacctgctccgccagg

SEQ ID NO: 41 - DNA, 20 bp, Artificial Sequence
  Description of Artificial Sequence: Synthetic probe
tgttccgtttcttctccctg

SEQ ID NO: 42 - DNA, 20 bp, Artificial Sequence
  Description of Artificial Sequence: Synthetic probe
cttctcccctttgtcatctc

SEQ ID NO: 43 - DNA, 20 bp, Artificial Sequence
  Description of Artificial Sequence: Synthetic probe
gctcattttgggtatcactg

SEQ ID NO: 44 - DNA, 20 bp, Artificial Sequence
  Description of Artificial Sequence: Synthetic probe
gagtctgatggaaagagata

SEQ ID NO: 45 - DNA, 20 bp, Artificial Sequence
  Description of Artificial Sequence: Synthetic probe
ccgcccagtatgggctagag

SEQ ID NO: 46 - DNA, 20 bp, Artificial Sequence
  Description of Artificial Sequence: Synthetic probe
caggtcttcatcatgccttg

SEQ ID NO: 47 - DNA, 20 bp, Artificial Sequence
  Description of Artificial Sequence: Synthetic probe
cctggggagcagcgctaacc

SEQ ID NO: 48 - DNA, 20 bp, Artificial Sequence
  Description of Artificial Sequence: Synthetic probe
ctggaggcagcctttgggtg

SEQ ID NO: 49 - DNA, 20 bp, Artificial Sequence
  Description of Artificial Sequence: Synthetic probe
acacggagcgcctggagcgc

SEQ ID NO: 50 - DNA, 20 bp, Artificial Sequence
  Description of Artificial Sequence: Synthetic probe
ctgtctgcagagaggagcca

SEQ ID NO: 51 - DNA, 20 bp, Artificial Sequence
  Description of Artificial Sequence: Synthetic probe
actctgctattggatatatc

SEQ ID NO: 52 - DNA, 20 bp, Artificial Sequence
  Description of Artificial Sequence: Synthetic probe
cacagtctgatgggcaactt

SEQ ID NO: 53 - DNA, 20 bp, Artificial Sequence
  Description of Artificial Sequence: Synthetic probe
acggggccagctggacacac

SEQ ID NO: 54 - DNA, 20 bp, Artificial Sequence
  Description of Artificial Sequence: Synthetic probe
ggtgagattttctcgtatgt

SEQ ID NO: 55 - DNA, 20 bp, Artificial Sequence
  Description of Artificial Sequence: Synthetic probe
cctgtcttcctctgcaagtg

SEQ ID NO: 56 - DNA, 20 bp, Artificial Sequence
  Description of Artificial Sequence: Synthetic probe
ctcagggaaatggccttccc

SEQ ID NO: 57 - DNA, 20 bp, Artificial Sequence
  Description of Artificial Sequence: Synthetic probe
tcattttataacactctagc

SEQ ID NO: 58 - DNA, 20 bp, Artificial Sequence
  Description of Artificial Sequence: Synthetic probe
ccctgcccttattgggggac

SEQ ID NO: 59 - DNA, 20 bp, Artificial Sequence
  Description of Artificial Sequence: Synthetic probe
ccacggagacccatgaggag

SEQ ID NO: 60 - DNA, 20 bp, Artificial Sequence
  Description of Artificial Sequence: Synthetic probe
ctgctgtacaacaaggagaa

SEQ ID NO: 61 - DNA, 20 bp, Artificial Sequence
  Description of Artificial Sequence: Synthetic probe
ggaaggatcccgggtctcag

SEQ ID NO: 62 - DNA, 20 bp, Artificial Sequence
  Description of Artificial Sequence: Synthetic probe
ctagaacacggtggaagaga

SEQ ID NO: 63 - DNA, 20 bp, Artificial Sequence
  Description of Artificial Sequence: Synthetic probe
tctgtaggagaattgaacag

SEQ ID NO: 64 - DNA, 20 bp, Artificial Sequence
  Description of Artificial Sequence: Synthetic probe
cactattttgaagatcgtgg

SEQ ID NO: 65 - DNA, 20 bp, Artificial Sequence
  Description of Artificial Sequence: Synthetic probe
catcaccgtcgtcctcctag

SEQ ID NO: 66 - DNA, 20 bp, Artificial Sequence
  Description of Artificial Sequence: Synthetic probe
cagtcatcattggcgtcaca

SEQ ID NO: 67 - DNA, 20 bp, Artificial Sequence
  Description of Artificial Sequence: Synthetic probe
cctctggtcctgggagtgtc

SEQ ID NO: 68 - DNA, 20 bp, Artificial Sequence
  Description of Artificial Sequence: Synthetic probe
cagaagtacatcgtggtctc

SEQ ID NO: 69 - DNA, 20 bp, Artificial Sequence
  Description of Artificial Sequence: Synthetic probe
agggcagtaggtcaaacgac

SEQ ID NO: 70 - DNA, 20 bp, Artificial Sequence
  Description of Artificial Sequence: Synthetic probe
ctcatcacagtcttccttcc

SEQ ID NO: 71 - DNA, 20 bp, Artificial Sequence
  Description of Artificial Sequence: Synthetic probe
gcctctgagaatgttggcag

SEQ ID NO: 72 - DNA, 20 bp, Artificial Sequence
  Description of Artificial Sequence: Synthetic probe
ctcacagagagcagggccgg

SEQ ID NO: 73 - DNA, 20 bp, Artificial Sequence
  Description of Artificial Sequence: Synthetic probe
gtcctgtacgacatttactg

SEQ ID NO: 74 - DNA, 20 bp, Artificial Sequence
  Description of Artificial Sequence: Synthetic probe
gtctgaggagatggaggacc

SEQ ID NO: 75 - DNA, 20 bp, Artificial Sequence
  Description of Artificial Sequence: Synthetic probe
ctcccaggctccttaccttg

SEQ ID NO: 76 - DNA, 20 bp, Artificial Sequence
  Description of Artificial Sequence: Synthetic probe
gtcttttccctgttcatctc

SEQ ID NO: 77 - DNA, 20 bp, Artificial Sequence
  Description of Artificial Sequence: Synthetic probe
taagaggaggaagcggctgg

SEQ ID NO: 78 - DNA, 20 bp, Artificial Sequence
  Description of Artificial Sequence: Synthetic probe
caactgaaggctggaacact

SEQ ID NO: 79 - DNA, 20 bp, Artificial Sequence
  Description of Artificial Sequence: Synthetic probe
gcatgttaatgactctgatg

SEQ ID NO: 80 - DNA, 20 bp, Artificial Sequence
  Description of Artificial Sequence: Synthetic probe
gtgtcctcctctgggcagct

SEQ ID NO: 81 - DNA, 20 bp, Artificial Sequence
  Description of Artificial Sequence: Synthetic probe
ggaagttaaggtttcctcag

SEQ ID NO: 82 - DNA, 20 bp, Artificial Sequence
  Description of Artificial Sequence: Synthetic probe
ccacctgccgaacagtttct

SEQ ID NO: 83 - DNA, 20 bp, Artificial Sequence
  Description of Artificial Sequence: Synthetic probe
tcgggagaggcacaattcac

SEQ ID NO: 84 - DNA, 20 bp, Artificial Sequence
  Description of Artificial Sequence: Synthetic probe
gaagcagaggaagaaatagg

SEQ ID NO: 85 - DNA, 20 bp, Artificial Sequence
  Description of Artificial Sequence: Synthetic probe
gatgggataccgagattaag

SEQ ID NO: 86 - DNA, 20 bp, Artificial Sequence
  Description of Artificial Sequence: Synthetic probe
gatgatgtgattgaagaatg

SEQ ID NO: 87 - DNA, 20 bp, Artificial Sequence
  Description of Artificial Sequence: Synthetic probe
gctaaggacaagaccactgg

SEQ ID NO: 88 - DNA, 20 bp, Artificial Sequence
  Description of Artificial Sequence: Synthetic probe
ccaatccaagggcttcgcct

SEQ ID NO: 89 - DNA, 20 bp, Artificial Sequence
  Description of Artificial Sequence: Synthetic probe
ccagtgcacctgtagggaac

SEQ ID NO: 90 - DNA, 20 bp, Artificial Sequence
  Description of Artificial Sequence: Synthetic probe
caactagacttctctcctgg

SEQ ID NO: 91 - DNA, 20 bp, Artificial Sequence
  Description of Artificial Sequence: Synthetic probe
tccccctcactaccttcctc

SEQ ID NO: 92 - DNA, 20 bp, Artificial Sequence
  Description of Artificial Sequence: Synthetic probe
ctgtacaactttgctgacct

SEQ ID NO: 93 - DNA, 20 bp, Artificial Sequence
  Description of Artificial Sequence: Synthetic probe
aaacggggcttacgccattg

SEQ ID NO: 94 - DNA, 20 bp, Artificial Sequence
  Description of Artificial Sequence: Synthetic probe
gaaacctcaaggaaaactcc

SEQ ID NO: 95 - DNA, 20 bp, Artificial Sequence
  Description of Artificial Sequence: Synthetic probe
tggaattgccattgcctatg

SEQ ID NO: 96 - DNA, 20 bp, Artificial Sequence
  Description of Artificial Sequence: Synthetic probe
ctacacttgagtatttcatc

SEQ ID NO: 97 - DNA, 20 bp, Artificial Sequence
  Description of Artificial Sequence: Synthetic probe
ctgctggctacatcatctcg

SEQ ID NO: 98 - DNA, 20 bp, Artificial Sequence
  Description of Artificial Sequence: Synthetic probe
gttccgcatgatgaatctgc

SEQ ID NO: 99 - DNA, 20 bp, Artificial Sequence
  Description of Artificial Sequence: Synthetic probe
gtgacctatttgcacagacc

SEQ ID NO: 100 - DNA, 20 bp, Artificial Sequence
  Description of Artificial Sequence: Synthetic probe
gtcgtcttccctccagtctt

SEQ ID NO: 101 - DNA, 20 bp, Artificial Sequence
  Description of Artificial Sequence: Synthetic probe
cacaggaggcaggccatgac

SEQ ID NO: 102 - DNA, 20 bp, Artificial Sequence
  Description of Artificial Sequence: Synthetic probe
ctcatggacatcttcctctg

SEQ ID NO: 103 - DNA, 20 bp, Artificial Sequence
  Description of Artificial Sequence: Synthetic probe
cctgaaattctgaaacactg

SEQ ID NO: 104 - DNA, 20 bp, Artificial Sequence
  Description of Artificial Sequence: Synthetic probe
cattcaactgggaattggaa

SEQ ID NO: 105 - DNA, 20 bp, Artificial Sequence
  Description of Artificial Sequence: Synthetic probe
aggtcatgcaggcctttacc

SEQ ID NO: 106 - DNA, 20 bp, Artificial Sequence
  Description of Artificial Sequence: Synthetic probe
ggcattgatgtggctcatgt

SEQ ID NO: 107 - DNA, 20 bp, Artificial Sequence
  Description of Artificial Sequence: Synthetic probe
acgcaggtgatgccagccag

SEQ ID NO: 108 - DNA, 20 bp, Artificial Sequence
  Description of Artificial Sequence: Synthetic probe
gcccaggagtgcccagcatc

SEQ ID NO: 109 - DNA, 20 bp, Artificial Sequence
  Description of Artificial Sequence: Synthetic probe
gcggatgaactgacatgctc

SEQ ID NO: 110 - DNA, 20 bp, Artificial Sequence
  Description of Artificial Sequence: Synthetic probe
ctaccatgaccaggctctgg

SEQ ID NO: 111 - DNA, 20 bp, Artificial Sequence
  Description of Artificial Sequence: Synthetic probe
aagcctctgcaacaagtcag

SEQ ID NO: 112 - DNA, 20 bp, Artificial Sequence
  Description of Artificial Sequence: Synthetic probe
gtggtggtcatgtttccctt

SEQ ID NO: 113 - DNA, 20 bp, Artificial Sequence
  Description of Artificial Sequence: Synthetic probe
accacagagatgttttctcc

SEQ ID NO: 114 - DNA, 20 bp, Artificial Sequence
  Description of Artificial Sequence: Synthetic probe
gctctgacttgtggctcagg

SEQ ID NO: 115 - DNA, 20 bp, Artificial Sequence
  Description of Artificial Sequence: Synthetic probe
gccaaagctctgggtgacac

SEQ ID NO: 116 - DNA, 20 bp, Artificial Sequence
  Description of Artificial Sequence: Synthetic probe
gtggctccagatcaaagcgg

SEQ ID NO: 117 - DNA, 20 bp, Artificial Sequence
  Description of Artificial Sequence: Synthetic probe
tttctacctgccacgcgtcg

SEQ ID NO: 118 - DNA, 20 bp, Artificial Sequence
  Description of Artificial Sequence: Synthetic probe
gtgaaggttgggactcgact

SEQ ID NO: 119 - DNA, 20 bp, Artificial Sequence
  Description of Artificial Sequence: Synthetic probe
tatatcacatacccaatagg

SEQ ID NO: 120 - DNA, 20 bp, Artificial Sequence
  Description of Artificial Sequence: Synthetic probe
caccacgatgaagatcagag

SEQ ID NO: 121 - DNA, 20 bp, Artificial Sequence
  Description of Artificial Sequence: Synthetic probe
ttttacgccttgcagctgtg

SEQ ID NO: 122 - DNA, 20 bp, Artificial Sequence
  Description of Artificial Sequence: Synthetic probe
gaacttggtcttacagcctc

SEQ ID NO: 123 - DNA, 20 bp, Artificial Sequence
  Description of Artificial Sequence: Synthetic probe
tggggcacctagagttctcg

SEQ ID NO: 124 - DNA, 20 bp, Artificial Sequence
  Description of Artificial Sequence: Synthetic probe
gtgtgtctccttcattcatt

SEQ ID NO: 125 - DNA, 20 bp, Artificial Sequence
  Description of Artificial Sequence: Synthetic probe
cagcgacacacatgtgcaag

SEQ ID NO: 126 - DNA, 20 bp, Artificial Sequence
  Description of Artificial Sequence: Synthetic probe
ctgtgcctacaactaaagta

SEQ ID NO: 127 - DNA, 20 bp, Artificial Sequence
  Description of Artificial Sequence: Synthetic probe
gaaactgaacagtgaagtgg

SEQ ID NO: 128 - DNA, 20 bp, Artificial Sequence
  Description of Artificial Sequence: Synthetic probe
cttgattgcttaaactattg

SEQ ID NO: 129 - DNA, 20 bp, Artificial Sequence
  Description of Artificial Sequence: Synthetic probe
ctggccatgtgatcgtgttg

SEQ ID NO: 130 - DNA, 20 bp, Artificial Sequence
  Description of Artificial Sequence: Synthetic probe
gtgacagaccctgatgtgct

SEQ ID NO: 131 - DNA, 20 bp, Artificial Sequence
  Description of Artificial Sequence: Synthetic probe
ggctttggggatatctccag

SEQ ID NO: 132 - DNA, 20 bp, Artificial Sequence
  Description of Artificial Sequence: Synthetic probe
cttggcccatcacctcagta

SEQ ID NO: 133 - DNA, 20 bp, Artificial Sequence
  Description of Artificial Sequence: Synthetic probe
gcccctccactgagagttgg

SEQ ID NO: 134 - DNA, 20 bp, Artificial Sequence
  Description of Artificial Sequence: Synthetic probe
ctgaaacaaagaatttgtcc

SEQ ID NO: 135 - DNA, 20 bp, Artificial Sequence
  Description of Artificial Sequence: Synthetic probe
attttaagcaggagcaggtg

SEQ ID NO: 136 - DNA, 20 bp, Artificial Sequence
  Description of Artificial Sequence: Synthetic probe
gctggtttgaagccccaggt

SEQ ID NO: 137 - DNA, 20 bp, Artificial Sequence
  Description of Artificial Sequence: Synthetic probe
gctccctgtcagagtcaaag

SEQ ID NO: 138 - DNA, 20 bp, Artificial Sequence
  Description of Artificial Sequence: Synthetic probe
cacaaatcctcaggacgggc

SEQ ID NO: 139 - DNA, 20 bp, Artificial Sequence
  Description of Artificial Sequence: Synthetic probe
tttctgcccagtgggtcttg

SEQ ID NO: 140 - DNA, 20 bp, Artificial Sequence
  Description of Artificial Sequence: Synthetic probe
gcataagtagattaatcctg

SEQ ID NO: 141 - DNA, 20 bp, Artificial Sequence
  Description of Artificial Sequence: Synthetic probe
gagttaaagaagaggcgtgg

SEQ ID NO: 142 - DNA, 20 bp, Artificial Sequence
  Description of Artificial Sequence: Synthetic probe
gaatccaggcagtggttttt

SEQ ID NO: 143 - DNA, 20 bp, Artificial Sequence
  Description of Artificial Sequence: Synthetic probe
aacaagaaactggggtcttc

SEQ ID NO: 144 - DNA, 20 bp, Artificial Sequence
  Description of Artificial Sequence: Synthetic probe
ctctcccccgaacctctccc

SEQ ID NO: 145 - DNA, 20 bp, Artificial Sequence
  Description of Artificial Sequence: Synthetic probe
gcctctgaaggaaggttggc

SEQ ID NO: 146 - DNA, 20 bp, Artificial Sequence
  Description of Artificial Sequence: Synthetic probe
ctgaagaactgaaagaacct

SEQ ID NO: 147 - DNA, 20 bp, Artificial Sequence
  Description of Artificial Sequence: Synthetic probe
cttccctagaagaatggttg

SEQ ID NO: 148 - DNA, 20 bp, Artificial Sequence
  Description of Artificial Sequence: Synthetic probe
ctgatatggctactgcttct

SEQ ID NO: 149 - DNA, 20 bp, Artificial Sequence
  Description of Artificial Sequence: Synthetic probe
ggttctgcaatatctctgag

SEQ ID NO: 150 - DNA, 20 bp, Artificial Sequence
  Description of Artificial Sequence: Synthetic probe
gtgcaaagaatgcacttttc

SEQ ID NO: 151 - DNA, 20 bp, Artificial Sequence
  Description of Artificial Sequence: Synthetic probe
tgaagatgtggatgataatg

SEQ ID NO: 152 - DNA, 20 bp, Artificial Sequence
  Description of Artificial Sequence: Synthetic probe
gtgccttgatttccaaatga

SEQ ID NO: 153 - DNA, 20 bp, Artificial Sequence
  Description of Artificial Sequence: Synthetic probe
gaacaatcaaagttgagaag

SEQ ID NO: 154 - DNA, 20 bp, Artificial Sequence
  Description of Artificial Sequence: Synthetic probe
ccaaccatgcaagccagccg

SEQ ID NO: 155 - DNA, 20 bp, Artificial Sequence
  Description of Artificial Sequence: Synthetic probe
gttgccagggatagggactg

SEQ ID NO: 156 - DNA, 20 bp, Artificial Sequence
  Description of Artificial Sequence: Synthetic probe
gagggggtgtggggtatgta

SEQ ID NO: 157 - DNA, 20 bp, Artificial Sequence
  Description of Artificial Sequence: Synthetic probe
agaggacatggggaagggac

SEQ ID NO: 158 - DNA, 20 bp, Artificial Sequence
  Description of Artificial Sequence: Synthetic probe
cagtgtatcagttgcgtgga

SEQ ID NO: 159 - DNA, 20 bp, Artificial Sequence
  Description of Artificial Sequence: Synthetic probe
agatgcgttggtccataaag

SEQ ID NO: 160 - DNA, 20 bp, Artificial Sequence
  Description of Artificial Sequence: Synthetic probe
gattgtatcaagtagatggg

SEQ ID NO: 161 - DNA, 20 bp, Artificial Sequence
  Description of Artificial Sequence: Synthetic probe
gtgagactagaagaggggag

SEQ ID NO: 162 - DNA, 20 bp, Artificial Sequence
  Description of Artificial Sequence: Synthetic probe
cagaaagggaccttgagtag

SEQ ID NO: 163 - DNA, 20 bp, Artificial Sequence
  Description of Artificial Sequence: Synthetic probe
atgggtcattctagtctaag

SEQ ID NO: 164 - DNA, 20 bp, Artificial Sequence
  Description of Artificial Sequence: Synthetic probe
gactactagtagaaccctca

SEQ ID NO: 165 - DNA, 20 bp, Artificial Sequence
  Description of Artificial Sequence: Synthetic probe
aagacgcgcctgggctccgc

SEQ ID NO: 166 - DNA, 20 bp, Artificial Sequence
  Description of Artificial Sequence: Synthetic probe
gctctcagagaagcacgtgg

SEQ ID NO: 167 - DNA, 20 bp, Artificial Sequence
  Description of Artificial Sequence: Synthetic probe
acgactgagccctgcttctg

SEQ ID NO: 168 - DNA, 20 bp, Artificial Sequence
  Description of Artificial Sequence: Synthetic probe
ctggggctgtgtacagagtg

SEQ ID NO: 169 - DNA, 20 bp, Artificial Sequence
  Description of Artificial Sequence: Synthetic probe
ctaggattggtgggtttctg

SEQ ID NO: 170 - DNA, 20 bp, Artificial Sequence
  Description of Artificial Sequence: Synthetic probe
gttctcaactcccggtccct

SEQ ID NO: 171 - DNA, 20 bp, Artificial Sequence
  Description of Artificial Sequence: Synthetic probe
ccctcctcatctccctcaag

SEQ ID NO: 172 - DNA, 20 bp, Artificial Sequence
  Description of Artificial Sequence: Synthetic probe
gatggctacgtacccccaaa

SEQ ID NO: 173 - DNA, 20 bp, Artificial Sequence
  Description of Artificial Sequence: Synthetic probe
tgtgtctcaccccctcacag

SEQ ID NO: 174 - DNA, 20 bp, Artificial Sequence
  Description of Artificial Sequence: Synthetic probe
gacagagctgtatctgcata

SEQ ID NO: 175 - DNA, 20 bp, Artificial Sequence
  Description of Artificial Sequence: Synthetic probe
ggaaagagtgatctggtgtc

SEQ ID NO: 176 - DNA, 20 bp, Artificial Sequence
  Description of Artificial Sequence: Synthetic probe
gaataggaggacccatgtag

SEQ ID NO: 177 - DNA, 20 bp, Artificial Sequence
  Description of Artificial Sequence: Synthetic probe
aactgtgaagccaccctggg

SEQ ID NO: 178 - DNA, 20 bp, Artificial Sequence
  Description of Artificial Sequence: Synthetic probe
ctacagaaaccacagtcttc

SEQ ID NO: 179 - DNA, 20 bp, Artificial Sequence
  Description of Artificial Sequence: Synthetic probe
tccatgttggaactgtcgtg

SEQ ID NO: 180 - DNA, 20 bp, Artificial Sequence
  Description of Artificial Sequence: Synthetic probe
gaagggaacgaagcccatag

SEQ ID NO: 181 - DNA, 20 bp, Artificial Sequence
  Description of Artificial Sequence: Synthetic probe
agaagcaaaccgccctgcag

SEQ ID NO: 182 - DNA, 20 bp, Artificial Sequence
  Description of Artificial Sequence: Synthetic probe
catccctcagcctgtaccgg

SEQ ID NO: 183 - DNA, 20 bp, Artificial Sequence
  Description of Artificial Sequence: Synthetic probe
cgggcaatccagacagcagg

SEQ ID NO: 184 - DNA, 20 bp, Artificial Sequence
  Description of Artificial Sequence: Synthetic probe
cataaggcaccagttaccct

SEQ ID NO: 185 - DNA, 20 bp, Artificial Sequence
  Description of Artificial Sequence: Synthetic probe
tagggagatgcggggagcag

SEQ ID NO: 186 - DNA, 20 bp, Artificial Sequence
  Description of Artificial Sequence: Synthetic probe
ggtgggcaggaatactgtta

SEQ ID NO: 187 - DNA, 20 bp, Artificial Sequence
  Description of Artificial Sequence: Synthetic probe
atcctcaatttatcggaagg

SEQ ID NO: 188 - DNA, 20 bp, Artificial Sequence
  Description of Artificial Sequence: Synthetic probe
caggttgccacattccacaa

SEQ ID NO: 189 - DNA, 20 bp, Artificial Sequence
  Description of Artificial Sequence: Synthetic probe
tagaccgcgtgataaaactg

SEQ ID NO: 190 - DNA, 20 bp, Artificial Sequence
  Description of Artificial Sequence: Synthetic probe
ggttgagggatgctggaacc

SEQ ID NO: 191 - DNA, 20 bp, Artificial Sequence
  Description of Artificial Sequence: Synthetic probe
tggtggcgttttctgtactg

SEQ ID NO: 192 - DNA, 20 bp, Artificial Sequence
  Description of Artificial Sequence: Synthetic probe
gattgcaccaaggaagcttt

SEQ ID NO: 193 - DNA, 20 bp, Artificial Sequence
  Description of Artificial Sequence: Synthetic probe
tgggagtacagtgccattag

SEQ ID NO: 194 - DNA, 20 bp, Artificial Sequence
  Description of Artificial Sequence: Synthetic probe
gaccagcaagtgacacagga

SEQ ID NO: 195 - DNA, 20 bp, Artificial Sequence
  Description of Artificial Sequence: Synthetic probe
ctttgtttggcaggattctg

SEQ ID NO: 196 - DNA, 20 bp, Artificial Sequence
  Description of Artificial Sequence: Synthetic probe
caaaatgtgtctcacccact

SEQ ID NO: 197 - DNA, 20 bp, Artificial Sequence
  Description of Artificial Sequence: Synthetic probe
agctggaagagagttttcag

SEQ ID NO: 198 - DNA, 20 bp, Artificial Sequence
  Description of Artificial Sequence: Synthetic probe
gaactagtggaagattaccg

SEQ ID NO: 199 - DNA, 20 bp, Artificial Sequence
  Description of Artificial Sequence: Synthetic probe
actgtacttgctgggtcttg

SEQ ID NO: 200 - DNA, 20 bp, Artificial Sequence
  Description of Artificial Sequence: Synthetic probe
ccaagatcatttattccgct

SEQ ID NO: 201 - DNA, 20 bp, Artificial Sequence
  Description of Artificial Sequence: Synthetic probe
ctctcatccaggaaatgttg

SEQ ID NO: 202 - DNA, 20 bp, Artificial Sequence
  Description of Artificial Sequence: Synthetic probe
gagaactcagagggcctgga

SEQ ID NO: 203 - DNA, 20 bp, Artificial Sequence
  Description of Artificial Sequence: Synthetic probe
ttaccaaaatatacagtgtg

SEQ ID NO: 204 - DNA, 20 bp, Artificial Sequence
  Description of Artificial Sequence: Synthetic probe
gtgaaggttgactgaagaag

SEQ ID NO: 205 - DNA, 20 bp, Artificial Sequence
  Description of Artificial Sequence: Synthetic probe
ggtgatatttttatgtgcag

SEQ ID NO: 206 - DNA, 20 bp, Artificial Sequence
  Description of Artificial Sequence: Synthetic probe
cgacccttggtgtttccctt

SEQ ID NO: 207 - DNA, 20 bp, Artificial Sequence
  Description of Artificial Sequence: Synthetic probe
gctcctgccccctccctgaa

SEQ ID NO: 208 - DNA, 20 bp, Artificial Sequence
  Description of Artificial Sequence: Synthetic probe
ctattttgtgctgtgtatat

SEQ ID NO: 209 - DNA, 20 bp, Artificial Sequence
  Description of Artificial Sequence: Synthetic probe
gactgatgccgaaatgtcac

SEQ ID NO: 210 - DNA, 20 bp, Artificial Sequence
  Description of Artificial Sequence: Synthetic probe
caggtcctttcagtcttcac

SEQ ID NO: 211 - DNA, 20 bp, Artificial Sequence
  Description of Artificial Sequence: Synthetic probe
aaaagcatgattcccacaag

SEQ ID NO: 212 - DNA, 20 bp, Artificial Sequence
  Description of Artificial Sequence: Synthetic probe
gactaagtatcagtgatttg

SEQ ID NO: 213 - DNA, 20 bp, Artificial Sequence
  Description of Artificial Sequence: Synthetic probe
gtggatatttatatatgtac

SEQ ID NO: 214 - DNA, 20 bp, Artificial Sequence
  Description of Artificial Sequence: Synthetic probe
cctgcactcatgaatgtatg

SEQ ID NO: 215 - DNA, 20 bp, Artificial Sequence
  Description of Artificial Sequence: Synthetic probe
ggccctagctttggaacgag

SEQ ID NO: 216 - DNA, 20 bp, Artificial Sequence
  Description of Artificial Sequence: Synthetic probe
gaattgggagattccaggag

SEQ ID NO: 217 - DNA, 20 bp, Artificial Sequence
  Description of Artificial Sequence: Synthetic probe
ctgatggcacatggacttgg

SEQ ID NO: 218 - DNA, 20 bp, Artificial Sequence
  Description of Artificial Sequence: Synthetic probe
caacagggtatcggtgatga

SEQ ID NO: 219 - DNA, 20 bp, Artificial Sequence
  Description of Artificial Sequence: Synthetic probe
tagtatatttaaacttacag

SEQ ID NO: 220 - DNA, 20 bp, Artificial Sequence
  Description of Artificial Sequence: Synthetic probe
gcttatttgtaatgtaaacc

SEQ ID NO: 221 - DNA, 20 bp, Artificial Sequence
  Description of Artificial Sequence: Synthetic probe
caagactgctgaaagcaatc

SEQ ID NO: 222 - DNA, 20 bp, Artificial Sequence
  Description of Artificial Sequence: Synthetic probe
cagttgctcctgtgctagat

SEQ ID NO: 223 - DNA, 20 bp, Artificial Sequence
  Description of Artificial Sequence: Synthetic probe
gattccgcagtgagagagtg

SEQ ID NO: 224 - DNA, 20 bp, Artificial Sequence
  Description of Artificial Sequence: Synthetic probe
gctggggcatggaaggcaag

SEQ ID NO: 225 - DNA, 20 bp, Artificial Sequence
  Description of Artificial Sequence: Synthetic probe
gccttaggtagttgggcttg

SEQ ID NO: 226 - DNA, 20 bp, Artificial Sequence
  Description of Artificial Sequence: Synthetic probe
cccaccctagtttgcttttg

SEQ ID NO: 227 - DNA, 20 bp, Artificial Sequence
  Description of Artificial Sequence: Synthetic probe
atgagtgtgtgacgttgctg

SEQ ID NO: 228 - DNA, 20 bp, Artificial Sequence
  Description of Artificial Sequence: Synthetic probe
cacgcctgactctgtgcgag

SEQ ID NO: 229 - DNA, 20 bp, Artificial Sequence
  Description of Artificial Sequence: Synthetic probe
gaaagctgggcctgtcgaag

SEQ ID NO: 230 - DNA, 20 bp, Artificial Sequence
  Description of Artificial Sequence: Synthetic probe
gatgacagggatgtgctgcc

SEQ ID NO: 231 - DNA, 20 bp, Artificial Sequence
  Description of Artificial Sequence: Synthetic probe
aagcctcacctgaacctgtg

SEQ ID NO: 232 - DNA, 20 bp, Artificial Sequence
  Description of Artificial Sequence: Synthetic probe
gctggaagcccccgacctcc

SEQ ID NO: 233 - DNA, 20 bp, Artificial Sequence
  Description of Artificial Sequence: Synthetic probe
cacagtagccttgctgaagc

SEQ ID NO: 234 - DNA, 20 bp, Artificial Sequence
  Description of Artificial Sequence: Synthetic probe
catcacagatgggagaaggc

SEQ ID NO: 235 - DNA, 20 bp, Artificial Sequence
  Description of Artificial Sequence: Synthetic probe
tacatagaagccaccggatg

SEQ ID NO: 236 - DNA, 20 bp, Artificial Sequence
  Description of Artificial Sequence: Synthetic probe
gcacttccccaccggatgga

SEQ ID NO: 237 - DNA, 20 bp, Artificial Sequence
  Description of Artificial Sequence: Synthetic probe
ttcactaaataagcatgtag

SEQ ID NO: 238 - DNA, 20 bp, Artificial Sequence
  Description of Artificial Sequence: Synthetic probe
ctcagtggtttccaaatttg

SEQ ID NO: 239 - DNA, 20 bp, Artificial Sequence
  Description of Artificial Sequence: Synthetic probe
attcgacctgactgccgttg

SEQ ID NO: 240 - DNA, 20 bp, Artificial Sequence
  Description of Artificial Sequence: Synthetic probe
gaccgtaggccctggactgc

SEQ ID NO: 241 - DNA, 20 bp, Artificial Sequence
  Description of Artificial Sequence: Synthetic probe
acgagggcactctgagatag

SEQ ID NO: 242 - DNA, 20 bp, Artificial Sequence
  Description of Artificial Sequence: Synthetic probe
cactgctctggggccatctg

SEQ ID NO: 243 - DNA, 20 bp, Artificial Sequence
  Description of Artificial Sequence: Synthetic probe
gcaggtttgcttgacctctg

SEQ ID NO: 244 - DNA, 20 bp, Artificial Sequence
  Description of Artificial Sequence: Synthetic probe
cctcagttctcgactctaaa

SEQ ID NO: 245 - DNA, 20 bp, Artificial Sequence
  Description of Artificial Sequence: Synthetic probe
agcaagtagagtgttggtgg

SEQ ID NO: 246 - DNA, 20 bp, Artificial Sequence
  Description of Artificial Sequence: Synthetic probe
cccaagcaaaccagtgttgc

SEQ ID NO: 247 - DNA, 20 bp, Artificial Sequence
  Description of Artificial Sequence: Synthetic probe
gatggagatgattgttcggg

SEQ ID NO: 248 - DNA, 20 bp, Artificial Sequence
  Description of Artificial Sequence: Synthetic probe
caagacagttgaattatact

SEQ ID NO: 249 - DNA, 20 bp, Artificial Sequence
  Description of Artificial Sequence: Synthetic probe
aaaaaccaatgtaggtatag

SEQ ID NO: 250 - DNA, 20 bp, Artificial Sequence
  Description of Artificial Sequence: Synthetic probe
gcattctaccctttgaaata

SEQ ID NO: 251 - DNA, 20 bp, Artificial Sequence
  Description of Artificial Sequence: Synthetic probe
ttatggggatttcttcatcc

SEQ ID NO: 252 - DNA, 20 bp, Artificial Sequence
  Description of Artificial Sequence: Synthetic probe
gtcagatccacaaatttgag

SEQ ID NO: 253 - DNA, 20 bp, Artificial Sequence
  Description of Artificial Sequence: Synthetic probe
ctgcttggtgtgtaggttcc

SEQ ID NO: 254 - DNA, 20 bp, Artificial Sequence
  Description of Artificial Sequence: Synthetic probe
gtatctccctggagaagcac

SEQ ID NO: 255 - DNA, 20 bp, Artificial Sequence
  Description of Artificial Sequence: Synthetic probe
gtgtagtaagttgtagaagg

SEQ ID NO: 256 - DNA, 20 bp, Artificial Sequence
  Description of Artificial Sequence: Synthetic probe
ctcgaggggacgtggactta

SEQ ID NO: 257 - DNA, 20 bp, Artificial Sequence
  Description of Artificial Sequence: Synthetic probe
cacacacctccgagacagtc

SEQ ID NO: 258 - DNA, 20 bp, Artificial Sequence
  Description of Artificial Sequence: Synthetic probe
cagtgtcacctctctcagag

SEQ ID NO: 259 - DNA, 20 bp, Artificial Sequence
  Description of Artificial Sequence: Synthetic probe
agaccagcaccagtgtctgc

SEQ ID NO: 260 - DNA, 20 bp, Artificial Sequence
  Description of Artificial Sequence: Synthetic probe
ctctgagaatgttggcagct

SEQ ID NO: 261 - DNA, 20 bp, Artificial Sequence
  Description of Artificial Sequence: Synthetic probe
tcaactacatgttctggggg

SEQ ID NO: 262 - DNA, 20 bp, Artificial Sequence
  Description of Artificial Sequence: Synthetic probe
cccggagatagatgactttg

SEQ ID NO: 263 - DNA, 20 bp, Artificial Sequence
  Description of Artificial Sequence: Synthetic probe
gggtgtgcattttaaaactc

SEQ ID NO: 264 - DNA, 20 bp, Artificial Sequence
  Description of Artificial Sequence: Synthetic probe
gattcatagacacaggtacc

SEQ ID NO: 265 - DNA, 20 bp, Artificial Sequence
  Description of Artificial Sequence: Synthetic probe
cataaacacacccaccagtg

SEQ ID NO: 266 - DNA, 20 bp, Artificial Sequence
  Description of Artificial Sequence: Synthetic probe
cagcctgaagtaactcccac

SEQ ID NO: 267 - DNA, 20 bp, Artificial Sequence
  Description of Artificial Sequence: Synthetic probe
aagctggatttacaggtcac

SEQ ID NO: 268 - DNA, 20 bp, Artificial Sequence
  Description of Artificial Sequence: Synthetic probe
ggctggactgaatgggcctt

SEQ ID NO: 269 - DNA, 20 bp, Artificial Sequence
  Description of Artificial Sequence: Synthetic probe
aatcagatgcagagaatgtg

SEQ ID NO: 270 - DNA, 20 bp, Artificial Sequence
  Description of Artificial Sequence: Synthetic probe
gatacagaataatgtacaag

SEQ ID NO: 271 - DNA, 20 bp, Artificial Sequence
  Description of Artificial Sequence: Synthetic probe
tggacagcaacagggacaac

SEQ ID NO: 272 - DNA, 20 bp, Artificial Sequence
  Description of Artificial Sequence: Synthetic probe
gaggtggacttccaagagta

SEQ ID NO: 273 - DNA, 20 bp, Artificial Sequence
  Description of Artificial Sequence: Synthetic probe
tagcacttgaccttttcgac

SEQ ID NO: 274 - DNA, 20 bp, Artificial Sequence
  Description of Artificial Sequence: Synthetic probe
gcttaacctttccgctgtcg

SEQ ID NO: 275 - DNA, 20 bp, Artificial Sequence
  Description of Artificial Sequence: Synthetic probe
cagcaccaaagttgtgggac

SEQ ID NO: 276 - DNA, 20 bp, Artificial Sequence
  Description of Artificial Sequence: Synthetic probe
atgttgctgtagactgctgc

SEQ ID NO: 277 - DNA, 20 bp, Artificial Sequence
  Description of Artificial Sequence: Synthetic probe
gaattttatcttcttccttg

SEQ ID NO: 278 - DNA, 20 bp, Artificial Sequence
  Description of Artificial Sequence: Synthetic probe
gcattggttcactggacatt

SEQ ID NO: 279 - DNA, 20 bp, Artificial Sequence
  Description of Artificial Sequence: Synthetic probe
gaccaggaactagcacacac

SEQ ID NO: 280 - DNA, 20 bp, Artificial Sequence
  Description of Artificial Sequence: Synthetic probe
ctgcatcagcaaaagtttca

SEQ ID NO: 281 - DNA, 20 bp, Artificial Sequence
  Description of Artificial Sequence: Synthetic probe
aaaagcctctttgttatcgg

SEQ ID NO: 282 - DNA, 20 bp, Artificial Sequence
  Description of Artificial Sequence: Synthetic probe
ccttgtgtcagcaggtcatg

SEQ ID NO: 283 - DNA, 20 bp, Artificial Sequence
  Description of Artificial Sequence: Synthetic probe
caacacttcattctctcttg

SEQ ID NO: 284 - DNA, 20 bp, Artificial Sequence
  Description of Artificial Sequence: Synthetic probe
ccctgtctctcaaataaacc

SEQ ID NO: 285 - DNA, 20 bp, Artificial Sequence
  Description of Artificial Sequence: Synthetic probe
gctgcaaggtataattgatg

SEQ ID NO: 286 - DNA, 20 bp, Artificial Sequence
  Description of Artificial Sequence: Synthetic probe
gattcttccatcctgccgga

SEQ ID NO: 287 - DNA, 20 bp, Artificial Sequence
  Description of Artificial Sequence: Synthetic probe
acttgttttcccgatgtgtc

SEQ ID NO: 288 - DNA, 20 bp, Artificial Sequence
  Description of Artificial Sequence: Synthetic probe
cagccagctccgcagcagct

SEQ ID NO: 289 - DNA, 20 bp, Artificial Sequence
  Description of Artificial Sequence: Synthetic probe
ctgcgaatgcagatcatgac

SEQ ID NO: 290 - DNA, 20 bp, Artificial Sequence
  Description of Artificial Sequence: Synthetic probe
ccacttgcctggagccatct

SEQ ID NO: 291 - DNA, 20 bp, Artificial Sequence
  Description of Artificial Sequence: Synthetic probe
ttggggcagccaggcccttg

SEQ ID NO: 292 - DNA, 20 bp, Artificial Sequence
  Description of Artificial Sequence: Synthetic probe
ccttcatttttacagaggta

SEQ ID NO: 293 - DNA, 20 bp, Artificial Sequence
  Description of Artificial Sequence: Synthetic probe
cgttctatatctcatcacag

SEQ ID NO: 294 - DNA, 20 bp, Artificial Sequence
  Description of Artificial Sequence: Synthetic probe
cgccagccctgtttttagcc

SEQ ID NO: 295 - DNA, 20 bp, Artificial Sequence
  Description of Artificial Sequence: Synthetic probe
acagcaagcagttgccttac

SEQ ID NO: 296 - DNA, 20 bp, Artificial Sequence
  Description of Artificial Sequence: Synthetic probe
cagtgaaaaaggtgcactga

SEQ ID NO: 297 - DNA, 20 bp, Artificial Sequence
  Description of Artificial Sequence: Synthetic probe
ccaaccttcacatctgtcac

SEQ ID NO: 298 - DNA, 20 bp, Artificial Sequence
  Description of Artificial Sequence: Synthetic probe
gttctccacacgggggagag

SEQ ID NO: 299 - DNA, 20 bp, Artificial Sequence
  Description of Artificial Sequence: Synthetic probe
tccctgaaacctagtactgc

SEQ ID NO: 300 - DNA, 20 bp, Artificial Sequence
  Description of Artificial Sequence: Synthetic probe
cccccatgaggaaggaacag

SEQ ID NO: 301 - DNA, 20 bp, Artificial Sequence
  Description of Artificial Sequence: Synthetic probe
tccacacgtgcccgaatctg

SEQ ID NO: 302 - DNA, 20 bp, Artificial Sequence
  Description of Artificial Sequence: Synthetic probe
ctgtgacctggatgtcttgg

SEQ ID NO: 303 - DNA, 20 bp, Artificial Sequence
  Description of Artificial Sequence: Synthetic probe
tgagagccccacaggctctg

SEQ ID NO: 304 - DNA, 20 bp, Artificial Sequence
  Description of Artificial Sequence: Synthetic probe
ccacacccgtgacttcatcc

SEQ ID NO: 305 - DNA, 20 bp, Artificial Sequence
  Description of Artificial Sequence: Synthetic probe
gtgtcctccatcccccagtg

SEQ ID NO: 306 - DNA, 20 bp, Artificial Sequence
  Description of Artificial Sequence: Synthetic probe
ccttcacatcttgaggatat

SEQ ID NO: 307 - DNA, 20 bp, Artificial Sequence
  Description of Artificial Sequence: Synthetic probe
atctgctggaagtgaggctg

SEQ ID NO: 308 - DNA, 20 bp, Artificial Sequence
  Description of Artificial Sequence: Synthetic probe
gtagtgactggatggacaca

SEQ ID NO: 309 - DNA, 20 bp, Artificial Sequence
  Description of Artificial Sequence: Synthetic probe
caggccctggctgagggcag

SEQ ID NO: 310 - DNA, 20 bp, Artificial Sequence
  Description of Artificial Sequence: Synthetic probe
ctgcgcgggcttatttatta

SEQ ID NO: 311 - DNA, 20 bp, Artificial Sequence
  Description of Artificial Sequence: Synthetic probe
aggaccctggggagagatgg

SEQ ID NO: 312 - DNA, 20 bp, Artificial Sequence
  Description of Artificial Sequence: Synthetic probe
gggcggggaaaatggaggta

SEQ ID NO: 313 - DNA, 20 bp, Artificial Sequence
  Description of Artificial Sequence: Synthetic probe
ctatgctgcagtggacaatc

SEQ ID NO: 314 - DNA, 20 bp, Artificial Sequence
  Description of Artificial Sequence: Synthetic probe
caatcttctacaaacctaac

SEQ ID NO: 315 - DNA, 20 bp, Artificial Sequence
  Description of Artificial Sequence: Synthetic probe
tgtaactgcattgagaactg

SEQ ID NO: 316 - DNA, 20 bp, Artificial Sequence
  Description of Artificial Sequence: Synthetic probe
catatgtttcgctgatatat

SEQ ID NO: 317 - DNA, 20 bp, Artificial Sequence
  Description of Artificial Sequence: Synthetic probe
gactctgaaaaacattccag

SEQ ID NO: 318 - DNA, 20 bp, Artificial Sequence
  Description of Artificial Sequence: Synthetic probe
gaaaccatggcagcatggag

SEQ ID NO: 319 - DNA, 20 bp, Artificial Sequence
  Description of Artificial Sequence: Synthetic probe
tggtaaaaaattggagacag

SEQ ID NO: 320 - DNA, 20 bp, Artificial Sequence
  Description of Artificial Sequence: Synthetic probe
cgggtgagtttgtagatgat

SEQ ID NO: 321 - DNA, 20 bp, Artificial Sequence
  Description of Artificial Sequence: Synthetic probe
aaatcaggagtgtggtagtg

SEQ ID NO: 322 - DNA, 20 bp, Artificial Sequence
  Description of Artificial Sequence: Synthetic probe
gattagtgaaagtctcctca

SEQ ID NO: 323 - DNA, 20 bp, Artificial Sequence
  Description of Artificial Sequence: Synthetic probe
gctgggcttttgaaggcgac

SEQ ID NO: 324 - DNA, 20 bp, Artificial Sequence
  Description of Artificial Sequence: Synthetic probe
caaggccaggtggtgatcca

SEQ ID NO: 325 - DNA, 20 bp, Artificial Sequence
  Description of Artificial Sequence: Synthetic probe
gtattctgtattttcactgg

SEQ ID NO: 326 - DNA, 20 bp, Artificial Sequence
  Description of Artificial Sequence: Synthetic probe
ccatattggaagcagttcta

SEQ ID NO: 327 - DNA, 20 bp, Artificial Sequence
  Description of Artificial Sequence: Synthetic probe
aaacaagcttctggtgggtg

SEQ ID NO: 328 - DNA, 20 bp, Artificial Sequence
  Description of Artificial Sequence: Synthetic probe
cattttctggcccggagttg

SEQ ID NO: 329 - DNA, 20 bp, Artificial Sequence
  Description of Artificial Sequence: Synthetic probe
ctaagtaaaattgccaagtg

SEQ ID NO: 330 - DNA, 20 bp, Artificial Sequence
  Description of Artificial Sequence: Synthetic probe
gacttggaagtccagaaagg

SEQ ID NO: 331 - DNA, 20 bp, Artificial Sequence
  Description of Artificial Sequence: Synthetic probe
gccttgactcccgctgcctg

SEQ ID NO: 332 - DNA, 20 bp, Artificial Sequence
  Description of Artificial Sequence: Synthetic probe
ctgaggggcaataaaccaga

SEQ ID NO: 333 - DNA, 20 bp, Artificial Sequence
  Description of Artificial Sequence: Synthetic probe
agctcataggtgttcatact

SEQ ID NO: 334 - DNA, 20 bp, Artificial Sequence
  Description of Artificial Sequence: Synthetic probe
gttacatccagaacatttgt

SEQ ID NO: 335 - DNA, 20 bp, Artificial Sequence
  Description of Artificial Sequence: Synthetic probe
catcagaattactttgaagg

SEQ ID NO: 336 - DNA, 20 bp, Artificial Sequence
  Description of Artificial Sequence: Synthetic probe
ctactattaatatgcagact

SEQ ID NO: 337 - DNA, 20 bp, Artificial Sequence
  Description of Artificial Sequence: Synthetic probe
tgatgttgaatcaactgatg

SEQ ID NO: 338 - DNA, 20 bp, Artificial Sequence
  Description of Artificial Sequence: Synthetic probe
ccagcagaaagctattttga

SEQ ID NO: 339 - DNA, 20 bp, Artificial Sequence
  Description of Artificial Sequence: Synthetic probe
tttcctctctgtgacagaac

SEQ ID NO: 340 - DNA, 20 bp, Artificial Sequence
  Description of Artificial Sequence: Synthetic probe
ccaggaattaattcctaaat

SEQ ID NO: 341 - DNA, 20 bp, Artificial Sequence
  Description of Artificial Sequence: Synthetic probe
gcagagacgcatacctagag

SEQ ID NO: 342 - DNA, 20 bp, Artificial Sequence
  Description of Artificial Sequence: Synthetic probe
gaactctaaccccggtgtac

SEQ ID NO: 343 - DNA, 20 bp, Artificial Sequence
  Description of Artificial Sequence: Synthetic probe
caaaggcctggaacacaatg

SEQ ID NO: 344 - DNA, 20 bp, Artificial Sequence
  Description of Artificial Sequence: Synthetic probe
gtactcaaaaacatagctgc

SEQ ID NO: 345 - DNA, 20 bp, Artificial Sequence
  Description of Artificial Sequence: Synthetic probe
cacttcccatgagatttctc

SEQ ID NO: 346 - DNA, 20 bp, Artificial Sequence
  Description of Artificial Sequence: Synthetic probe
cagtgcccgccagacctgac

SEQ ID NO: 347 - DNA, 20 bp, Artificial Sequence
  Description of Artificial Sequence: Synthetic probe
ttttctctgttgcatacatg

SEQ ID NO: 348 - DNA, 20 bp, Artificial Sequence
  Description of Artificial Sequence: Synthetic probe
cctggcatctgtctcccctt

SEQ ID NO: 349 - DNA, 20 bp, Artificial Sequence
  Description of Artificial Sequence: Synthetic probe
ggtggttgtgccttttgtag

SEQ ID NO: 350 - DNA, 20 bp, Artificial Sequence
  Description of Artificial Sequence: Synthetic probe
gctgttccctttgccttaaa

SEQ ID NO: 351 - DNA, 20 bp, Artificial Sequence
  Description of Artificial Sequence: Synthetic probe
cttcacacctactcacttta

SEQ ID NO: 352 - DNA, 20 bp, Artificial Sequence
  Description of Artificial Sequence: Synthetic probe
caactttgctcctaactgtg

SEQ ID NO: 353 - DNA, 20 bp, Artificial Sequence
  Description of Artificial Sequence: Synthetic probe
cccatcctgaatatcctttg

SEQ ID NO: 354 - DNA, 20 bp, Artificial Sequence
  Description of Artificial Sequence: Synthetic probe
caactccccaagagtgctta

SEQ ID NO: 355 - DNA, 20 bp, Artificial Sequence
  Description of Artificial Sequence: Synthetic probe
tgctgccttggcagacttac

SEQ ID NO: 356 - DNA, 20 bp, Artificial Sequence
  Description of Artificial Sequence: Synthetic probe
gatctcaacagttcatacga

SEQ ID NO: 357 - DNA, 20 bp, Artificial Sequence
  Description of Artificial Sequence: Synthetic probe
gaccaccgagtggcaaggtg

SEQ ID NO: 358 - DNA, 20 bp, Artificial Sequence
  Description of Artificial Sequence: Synthetic probe
gaaggaagcacaggcacaca

SEQ ID NO: 359 - DNA, 20 bp, Artificial Sequence
  Description of Artificial Sequence: Synthetic probe
agtatgttgtctttccaatg

SEQ ID NO: 360 - DNA, 20 bp, Artificial Sequence
  Description of Artificial Sequence: Synthetic probe
gtgccttgcttggtgctctc

SEQ ID NO: 361 - DNA, 20 bp, Artificial Sequence
  Description of Artificial Sequence: Synthetic probe
attctacctggagaccagag

SEQ ID NO: 362 - DNA, 20 bp, Artificial Sequence
  Description of Artificial Sequence: Synthetic probe
ctggcctgaaaattactggt

SEQ ID NO: 363 - DNA, 20 bp, Artificial Sequence
  Description of Artificial Sequence: Synthetic probe
tctaactcaagactgttctg

SEQ ID NO: 364 - DNA, 20 bp, Artificial Sequence
  Description of Artificial Sequence: Synthetic probe
gaatgagggtccaggcctgt

SEQ ID NO: 365 - DNA, 20 bp, Artificial Sequence
  Description of Artificial Sequence: Synthetic probe
ccaggagtgccatatttcag

SEQ ID NO: 366 - DNA, 20 bp, Artificial Sequence
  Description of Artificial Sequence: Synthetic probe
ctactgtatttcctttttct

SEQ ID NO: 367 - DNA, 20 bp, Artificial Sequence
  Description of Artificial Sequence: Synthetic probe
caccactgcaacatatagac

SEQ ID NO: 368 - DNA, 20 bp, Artificial Sequence
  Description of Artificial Sequence: Synthetic probe
ctgagtgctattgtattttg

SEQ ID NO: 369 - DNA, 20 bp, Artificial Sequence
  Description of Artificial Sequence: Synthetic probe
cttcattgtgtcaggatgac

SEQ ID NO: 370 - DNA, 20 bp, Artificial Sequence
  Description of Artificial Sequence: Synthetic probe
ctttcatatcattctcacca

SEQ ID NO: 371 - DNA, 20 bp, Artificial Sequence
  Description of Artificial Sequence: Synthetic probe
ctgtgcagggtatcctgtag

SEQ ID NO: 372 - DNA, 20 bp, Artificial Sequence
  Description of Artificial Sequence: Synthetic probe
ggtgacctggaattcgaatt

SEQ ID NO: 373 - DNA, 20 bp, Artificial Sequence
  Description of Artificial Sequence: Synthetic probe
tcacagggctcagggttatg

SEQ ID NO: 374 - DNA, 20 bp, Artificial Sequence
  Description of Artificial Sequence: Synthetic probe
ctcccgcttgaatctggacg

SEQ ID NO: 375 - DNA, 20 bp, Artificial Sequence
  Description of Artificial Sequence: Synthetic probe
ggctaagatttcactttaag

SEQ ID NO: 376 - DNA, 20 bp, Artificial Sequence
  Description of Artificial Sequence: Synthetic probe
cagtcgtgaactgtgcgagc

SEQ ID NO: 377 - DNA, 20 bp, Artificial Sequence
  Description of Artificial Sequence: Synthetic probe
tcagtcagattctttccttg

SEQ ID NO: 378 - DNA, 20 bp, Artificial Sequence
  Description of Artificial Sequence: Synthetic probe
gctcagttgtgtttgtattt

SEQ ID NO: 379 - DNA, 20 bp, Artificial Sequence
  Description of Artificial Sequence: Synthetic probe
caccaatcggccgttctacc

SEQ ID NO: 380 - DNA, 20 bp, Artificial Sequence
  Description of Artificial Sequence: Synthetic probe
gcattgtggctgctcacaac

SEQ ID NO: 381 - DNA, 20 bp, Artificial Sequence
  Description of Artificial Sequence: Synthetic probe
cacctacattccatagtggg

SEQ ID NO: 382 - DNA, 20 bp, Artificial Sequence
  Description of Artificial Sequence: Synthetic probe
cccgtggggctcctggtgca

SEQ ID NO: 383 - DNA, 20 bp, Artificial Sequence
  Description of Artificial Sequence: Synthetic probe
aggcatgggctgtacccaag

SEQ ID NO: 384 - DNA, 20 bp, Artificial Sequence
  Description of Artificial Sequence: Synthetic probe
ctgatttctcatctggtcaa

SEQ ID NO: 385 - DNA, 20 bp, Artificial Sequence
  Description of Artificial Sequence: Synthetic probe
ggggtagagctgatccagag

SEQ ID NO: 386 - DNA, 20 bp, Artificial Sequence
  Description of Artificial Sequence: Synthetic probe
cacagatctgtttcgtgcat

SEQ ID NO: 387 - DNA, 20 bp, Artificial Sequence
  Description of Artificial Sequence: Synthetic probe
gtgcccttctgttcctggag

SEQ ID NO: 388 - DNA, 20 bp, Artificial Sequence
  Description of Artificial Sequence: Synthetic probe
gattatgttcggtacacaaa

SEQ ID NO: 389 - DNA, 20 bp, Artificial Sequence
  Description of Artificial Sequence: Synthetic probe
cctgcagcaaatgactactg

SEQ ID NO: 390 - DNA, 20 bp, Artificial Sequence
  Description of Artificial Sequence: Synthetic probe
cacctggacagcctcctctt

SEQ ID NO: 391 - DNA, 20 bp, Artificial Sequence
  Description of Artificial Sequence: Synthetic probe
cagacattttaagatggtgg

SEQ ID NO: 392 - DNA, 20 bp, Artificial Sequence
  Description of Artificial Sequence: Synthetic probe
cagtagaggctatggacagg

SEQ ID NO: 393 - DNA, 20 bp, Artificial Sequence
  Description of Artificial Sequence: Synthetic probe
tgcagaggcaggcttcagag

SEQ ID NO: 394 - DNA, 20 bp, Artificial Sequence
  Description of Artificial Sequence: Synthetic probe
ctccaccagccatcaatgcc

SEQ ID NO: 395 - DNA, 20 bp, Artificial Sequence
  Description of Artificial Sequence: Synthetic probe
cccccaggacaacaaactgc

SEQ ID NO: 396 - DNA, 20 bp, Artificial Sequence
  Description of Artificial Sequence: Synthetic probe
ccttaagagtcatttccttg

SEQ ID NO: 397 - DNA, 20 bp, Artificial Sequence
  Description of Artificial Sequence: Synthetic probe
tccaaagagatgccttccag

SEQ ID NO: 398 - DNA, 20 bp, Artificial Sequence
  Description of Artificial Sequence: Synthetic probe
gatgaacaaaggcagaccag

SEQ ID NO: 399 - DNA, 20 bp, Artificial Sequence
  Description of Artificial Sequence: Synthetic probe
tgctaataatgccctgaaag

SEQ ID NO: 400 - DNA, 20 bp, Artificial Sequence
  Description of Artificial Sequence: Synthetic probe
cagattgggagagatggaaa

SEQ ID NO: 401 - DNA, 20 bp, Artificial Sequence
  Description of Artificial Sequence: Synthetic probe
agtttgcttctgtaagcaac

SEQ ID NO: 402 - DNA, 20 bp, Artificial Sequence
  Description of Artificial Sequence: Synthetic probe
gggaacacctgctgaggggg

SEQ ID NO: 403 - DNA, 20 bp, Artificial Sequence
  Description of Artificial Sequence: Synthetic probe
tctgtttactagctgcgtgg

SEQ ID NO: 404 - DNA, 20 bp, Artificial Sequence
  Description of Artificial Sequence: Synthetic probe
ccttggacgggtggctgaca

SEQ ID NO: 405 - DNA, 20 bp, Artificial Sequence
  Description of Artificial Sequence: Synthetic probe
gtttcatggacactgttgag

SEQ ID NO: 406 - DNA, 20 bp, Artificial Sequence
  Description of Artificial Sequence: Synthetic probe
caatgtacagtgtatggtgt

SEQ ID NO: 407 - DNA, 20 bp, Artificial Sequence
  Description of Artificial Sequence: Synthetic probe
gtgcaggcacatttccaagc

SEQ ID NO: 408 - DNA, 20 bp, Artificial Sequence
  Description of Artificial Sequence: Synthetic probe
gtaggtgtccctggcttttg

SEQ ID NO: 409 - DNA, 20 bp, Artificial Sequence
  Description of Artificial Sequence: Synthetic probe
agactggctaacccctcttc

SEQ ID NO: 410 - DNA, 20 bp, Artificial Sequence
  Description of Artificial Sequence: Synthetic probe
ctattaccttgatctcttcc

SEQ ID NO: 411 - DNA, 20 bp, Artificial Sequence
  Description of Artificial Sequence: Synthetic probe
catgtgaccacaaatgcttg

SEQ ID NO: 412 - DNA, 20 bp, Artificial Sequence
  Description of Artificial Sequence: Synthetic probe
cttggacttgcccatctagc

SEQ ID NO: 413 - DNA, 20 bp, Artificial Sequence
  Description of Artificial Sequence: Synthetic probe
ttatctgtgctctctgcccg

SEQ ID NO: 414 - DNA, 20 bp, Artificial Sequence
  Description of Artificial Sequence: Synthetic probe
ccagtgccttacaatttgca

SEQ ID NO: 415 - DNA, 20 bp, Artificial Sequence
  Description of Artificial Sequence: Synthetic probe
cttgccatcctgttagattg

SEQ ID NO: 416 - DNA, 20 bp, Artificial Sequence
  Description of Artificial Sequence: Synthetic probe
ccagttcctgggaccaggcc

SEQ ID NO: 417 - DNA, 20 bp, Artificial Sequence
  Description of Artificial Sequence: Synthetic probe
tcaatggagaggtcatccgg

SEQ ID NO: 418 - DNA, 20 bp, Artificial Sequence
  Description of Artificial Sequence: Synthetic probe
ctggatggggccattcgtat

SEQ ID NO: 419 - DNA, 20 bp, Artificial Sequence
  Description of Artificial Sequence: Synthetic probe
cttgcttttggctcatacag

SEQ ID NO: 420 - DNA, 20 bp, Artificial Sequence
  Description of Artificial Sequence: Synthetic probe
gagagagggaaggctgccag

SEQ ID NO: 421 - DNA, 20 bp, Artificial Sequence
  Description of Artificial Sequence: Synthetic probe
agattataagaactgatgtg

SEQ ID NO: 422 - DNA, 20 bp, Artificial Sequence
  Description of Artificial Sequence: Synthetic probe
gccagagtgcctacccactg

SEQ ID NO: 423 - DNA, 20 bp, Artificial Sequence
  Description of Artificial Sequence: Synthetic probe
tgtcacaagagtgggtgatc

SEQ ID NO: 424 - DNA, 20 bp, Artificial Sequence
  Description of Artificial Sequence: Synthetic probe
cagtgcctcattgttgggga

SEQ ID NO: 425 - DNA, 20 bp, Artificial Sequence
  Description of Artificial Sequence: Synthetic probe
ggtggtgctgttcttttctg

SEQ ID NO: 426 - DNA, 20 bp, Artificial Sequence
  Description of Artificial Sequence: Synthetic probe
gtggatttaatgctgactca

SEQ ID NO: 427 - DNA, 20 bp, Artificial Sequence
  Description of Artificial Sequence: Synthetic probe
ggcacacagggtactttctg

SEQ ID NO: 428 - DNA, 20 bp, Artificial Sequence
  Description of Artificial Sequence: Synthetic probe
gacccactgctggacagact

SEQ ID NO: 429 - DNA, 20 bp, Artificial Sequence
  Description of Artificial Sequence: Synthetic probe
gagtctcctctctgagactg

SEQ ID NO: 430 - DNA, 20 bp, Artificial Sequence
  Description of Artificial Sequence: Synthetic probe
ctaagtaggggcagtgatgg

SEQ ID NO: 431 - DNA, 20 bp, Artificial Sequence
  Description of Artificial Sequence: Synthetic probe
tcaggggacagcatctgcag

SEQ ID NO: 432 - DNA, 20 bp, Artificial Sequence
  Description of Artificial Sequence: Synthetic probe
cagttgctgaggctccgtca

SEQ ID NO: 433 - DNA, 20 bp, Artificial Sequence
  Description of Artificial Sequence: Synthetic probe
agagcaagcacgttttccac

SEQ ID NO: 434 - DNA, 20 bp, Artificial Sequence
  Description of Artificial Sequence: Synthetic probe
ctcactgtctccatcctcca

SEQ ID NO: 435 - DNA, 20 bp, Artificial Sequence
  Description of Artificial Sequence: Synthetic probe
ttgcatcttcattgcaaaag

SEQ ID NO: 436 - DNA, 20 bp, Artificial Sequence
  Description of Artificial Sequence: Synthetic probe
cactggctcatccgccctac

SEQ ID NO: 437 - DNA, 20 bp, Artificial Sequence
  Description of Artificial Sequence: Synthetic probe
aggaggtagtcactgagctg

SEQ ID NO: 438 - DNA, 20 bp, Artificial Sequence
  Description of Artificial Sequence: Synthetic probe
gaccttaaacacatctgcag

SEQ ID NO: 439 - DNA, 20 bp, Artificial Sequence
  Description of Artificial Sequence: Synthetic probe
gccccgccaagcagatgctg

SEQ ID NO: 440 - DNA, 20 bp, Artificial Sequence
  Description of Artificial Sequence: Synthetic probe
caaacagctaaactgtcata

SEQ ID NO: 441 - DNA, 20 bp, Artificial Sequence
  Description of Artificial Sequence: Synthetic probe
cgagagaatagtttgtcatc

SEQ ID NO: 442 - DNA, 20 bp, Artificial Sequence
  Description of Artificial Sequence: Synthetic probe
cacttagtgtgttagctggt

SEQ ID NO: 443 - DNA, 20 bp, Artificial Sequence
  Description of Artificial Sequence: Synthetic probe
cctgctgggacaccgcttgg

SEQ ID NO: 444 - DNA, 20 bp, Artificial Sequence
  Description of Artificial Sequence: Synthetic probe
gctttggtattgactgagtg

SEQ ID NO: 445 - DNA, 20 bp, Artificial Sequence
  Description of Artificial Sequence: Synthetic probe
cgaggtgtcaccctgcagag

SEQ ID NO: 446 - DNA, 20 bp, Artificial Sequence
  Description of Artificial Sequence: Synthetic probe
ctatggtgaggtgtggataa

SEQ ID NO: 447 - DNA, 20 bp, Artificial Sequence
  Description of Artificial Sequence: Synthetic probe
gcacaaggcaagtgagtttg

SEQ ID NO: 448 - DNA, 20 bp, Artificial Sequence
  Description of Artificial Sequence: Synthetic probe
cactgtcagccccagaccgt

SEQ ID NO: 449 - DNA, 20 bp, Artificial Sequence
  Description of Artificial Sequence: Synthetic probe
agacatgaactgactaattg

SEQ ID NO: 450 - DNA, 20 bp, Artificial Sequence
  Description of Artificial Sequence: Synthetic probe
gtatccactacttgtacagc

SEQ ID NO: 451 - DNA, 20 bp, Artificial Sequence
  Description of Artificial Sequence: Synthetic probe
tccaatgccaaacatttctg

SEQ ID NO: 452 - DNA, 20 bp, Artificial Sequence
  Description of Artificial Sequence: Synthetic probe
cacagggaagctagaggtgg

SEQ ID NO: 453 - DNA, 20 bp, Artificial Sequence
  Description of Artificial Sequence: Synthetic probe
gtctccctcccaacttatac

SEQ ID NO: 454 - DNA, 20 bp, Artificial Sequence
  Description of Artificial Sequence: Synthetic probe
gacctgatttccttaggacg

SEQ ID NO: 455 - DNA, 20 bp, Artificial Sequence
  Description of Artificial Sequence: Synthetic probe
gaaatgaatcaggattcgag

SEQ ID NO: 456 - DNA, 20 bp, Artificial Sequence
  Description of Artificial Sequence: Synthetic probe
ctctaggatgagacagaaaa

SEQ ID NO: 457 - DNA, 20 bp, Artificial Sequence
  Description of Artificial Sequence: Synthetic probe
gtaaatctgcccacacccag

SEQ ID NO: 458 - DNA, 20 bp, Artificial Sequence
  Description of Artificial Sequence: Synthetic probe
ctggccatatccacccctcg

SEQ ID NO: 459 - DNA, 20 bp, Artificial Sequence
  Description of Artificial Sequence: Synthetic probe
ttgtgccctttttcttattg

SEQ ID NO: 460 - DNA, 20 bp, Artificial Sequence
  Description of Artificial Sequence: Synthetic probe
gtttagaactcttgattttg

SEQ ID NO: 461 - DNA, 20 bp, Artificial Sequence
  Description of Artificial Sequence: Synthetic probe
ttgaactctggcaagagatg

SEQ ID NO: 462 - DNA, 20 bp, Artificial Sequence
  Description of Artificial Sequence: Synthetic probe
ccaaaaggcattggtaccgt

SEQ ID NO: 463 - DNA, 20 bp, Artificial Sequence
  Description of Artificial Sequence: Synthetic probe
tgctattagagcccatcctg

SEQ ID NO: 464 - DNA, 20 bp, Artificial Sequence
  Description of Artificial Sequence: Synthetic probe
gagccccacctctgaaccac

SEQ ID NO: 465 - DNA, 20 bp, Artificial Sequence
  Description of Artificial Sequence: Synthetic probe
cacacctgcctgcgttctcc

SEQ ID NO: 466 - DNA, 20 bp, Artificial Sequence
  Description of Artificial Sequence: Synthetic probe
ccatgaacttacatactagg

SEQ ID NO: 467 - DNA, 20 bp, Artificial Sequence
  Description of Artificial Sequence: Synthetic probe
aatctcccaaagagagaaac

SEQ ID NO: 468 - DNA, 20 bp, Artificial Sequence
  Description of Artificial Sequence: Synthetic probe
caatttctaagaggactgga

SEQ ID NO: 469 - DNA, 20 bp, Artificial Sequence
  Description of Artificial Sequence: Synthetic probe
gccccatcaaccccaccacg

SEQ ID NO: 470 - DNA, 20 bp, Artificial Sequence
  Description of Artificial Sequence: Synthetic probe
gaacattcgacccacatgga

SEQ ID NO: 471 - DNA, 20 bp, Artificial Sequence
  Description of Artificial Sequence: Synthetic probe
tcgtcaatccatcagcaatg

SEQ ID NO: 472 - DNA, 20 bp, Artificial Sequence
  Description of Artificial Sequence: Synthetic probe
cttctctcatagtgtcatag

SEQ ID NO: 473 - DNA, 20 bp, Artificial Sequence
  Description of Artificial Sequence: Synthetic probe
acgccccacactgcaatttg

SEQ ID NO: 474 - DNA, 20 bp, Artificial Sequence
  Description of Artificial Sequence: Synthetic probe
gtcttgttgccgtatccatt

SEQ ID NO: 475 - DNA, 20 bp, Artificial Sequence
  Description of Artificial Sequence: Synthetic probe
tccatcttccactgttagtg

SEQ ID NO: 476 - DNA, 20 bp, Artificial Sequence
  Description of Artificial Sequence: Synthetic probe
ccagtgagcaatactgttgt

SEQ ID NO: 477 - DNA, 20 bp, Artificial Sequence
  Description of Artificial Sequence: Synthetic probe
cgagaacgccatgattgctg

SEQ ID NO: 478 - DNA, 20 bp, Artificial Sequence
  Description of Artificial Sequence: Synthetic probe
ctggacttgttgacgaccct

SEQ ID NO: 479 - DNA, 20 bp, Artificial Sequence
  Description of Artificial Sequence: Synthetic probe
tgggcctgggggtttcctag

SEQ ID NO: 480 - DNA, 20 bp, Artificial Sequence
  Description of Artificial Sequence: Synthetic probe
cagaggatattggagcccct

SEQ ID NO: 481 - DNA, 20 bp, Artificial Sequence
  Description of Artificial Sequence: Synthetic probe
ggggttggggtaatattctg

SEQ ID NO: 482 - DNA, 20 bp, Artificial Sequence
  Description of Artificial Sequence: Synthetic probe
tggtcctcagccctgtacct

SEQ ID NO: 483 - DNA, 20 bp, Artificial Sequence
  Description of Artificial Sequence: Synthetic probe
gcttgcagcagaaatgaatg

SEQ ID NO: 484 - DNA, 20 bp, Artificial Sequence
  Description of Artificial Sequence: Synthetic probe
gggtttttgacactacattc

SEQ ID NO: 485 - DNA, 20 bp, Artificial Sequence
  Description of Artificial Sequence: Synthetic probe
ccagaatggtctttaatgag

SEQ ID NO: 486 - DNA, 20 bp, Artificial Sequence
  Description of Artificial Sequence: Synthetic probe
catggaacctgagcaaaggg

SEQ ID NO: 487 - DNA, 20 bp, Artificial Sequence
  Description of Artificial Sequence: Synthetic probe
ccttttaggagtaagccatc

SEQ ID NO: 488 - DNA, 20 bp, Artificial Sequence
  Description of Artificial Sequence: Synthetic probe
ccacaagttctataccatat

SEQ ID NO: 489 - DNA, 20 bp, Artificial Sequence
  Description of Artificial Sequence: Synthetic probe
cttctctgacctctacatgg

SEQ ID NO: 490 - DNA, 20 bp, Artificial Sequence
  Description of Artificial Sequence: Synthetic probe
cctccctcagctgcctgctc

SEQ ID NO: 491 - DNA, 20 bp, Artificial Sequence
  Description of Artificial Sequence: Synthetic probe
gccttggacccgagtgtgtg

SEQ ID NO: 492 - DNA, 20 bp, Artificial Sequence
  Description of Artificial Sequence: Synthetic probe
gctagggttgccctggctgg

SEQ ID NO: 493 - DNA, 20 bp, Artificial Sequence
  Description of Artificial Sequence: Synthetic probe
atcaggatcaaagcagacgg

SEQ ID NO: 494 - DNA, 20 bp, Artificial Sequence
  Description of Artificial Sequence: Synthetic probe
ggcgtgggtggggaaggggc

SEQ ID NO: 495 - DNA, 20 bp, Artificial Sequence
  Description of Artificial Sequence: Synthetic probe
tggaattgtggaagtggttg

SEQ ID NO: 496 - DNA, 20 bp, Artificial Sequence
  Description of Artificial Sequence: Synthetic probe
gaagagtaaccgccaaggcc

SEQ ID NO: 497 - DNA, 20 bp, Artificial Sequence
  Description of Artificial Sequence: Synthetic probe
cagttcaccccagagggtcg

SEQ ID NO: 498 - DNA, 20 bp, Artificial Sequence
  Description of Artificial Sequence: Synthetic probe
ggcaggttgacatatttatt

SEQ ID NO: 499 - DNA, 20 bp, Artificial Sequence
  Description of Artificial Sequence: Synthetic probe
tcagcttcagccaggcaacg

SEQ ID NO: 500 - DNA, 20 bp, Artificial Sequence
  Description of Artificial Sequence: Synthetic probe
ctaagctctgaagaactccc

SEQ ID NO: 501 - DNA, 20 bp, Artificial Sequence
  Description of Artificial Sequence: Synthetic probe
tgaaggatgaactaaggctg

SEQ ID NO: 502 - DNA, 20 bp, Artificial Sequence
  Description of Artificial Sequence: Synthetic probe
ctggtgccctgagcaactga

SEQ ID NO: 503 - DNA, 20 bp, Artificial Sequence
  Description of Artificial Sequence: Synthetic probe
aaggcactgtgtatgccctg

SEQ ID NO: 504 - DNA, 20 bp, Artificial Sequence
  Description of Artificial Sequence: Synthetic probe
caagttggctgtctatgagc

SEQ ID NO: 505 - DNA, 20 bp, Artificial Sequence
  Description of Artificial Sequence: Synthetic probe
gggattggacagtagtggtg

SEQ ID NO: 506 - DNA, 20 bp, Artificial Sequence
  Description of Artificial Sequence: Synthetic probe
catctggtccttgccgcctg

SEQ ID NO: 507 - DNA, 20 bp, Artificial Sequence
  Description of Artificial Sequence: Synthetic probe
aggtcctcatgaattaagtg

SEQ ID NO: 508 - DNA, 20 bp, Artificial Sequence
  Description of Artificial Sequence: Synthetic probe
ccatgctttgtgggagtctg

SEQ ID NO: 509 - DNA, 20 bp, Artificial Sequence
  Description of Artificial Sequence: Synthetic probe
gagccaaatgaggcacatac

SEQ ID NO: 510 - DNA, 20 bp, Artificial Sequence
  Description of Artificial Sequence: Synthetic probe
cgagtcagtagttgaagtcc

SEQ ID NO: 511 - DNA, 20 bp, Artificial Sequence
  Description of Artificial Sequence: Synthetic probe
tgtgagtcttcagcaccctc

SEQ ID NO: 512 - DNA, 20 bp, Artificial Sequence
  Description of Artificial Sequence: Synthetic probe
ccatgtaccttatatccctc

SEQ ID NO: 513 - DNA, 20 bp, Artificial Sequence
  Description of Artificial Sequence: Synthetic probe
cagtggcactgttaatatcc

SEQ ID NO: 514 - DNA, 20 bp, Artificial Sequence
  Description of Artificial Sequence: Synthetic probe
gcacaagagacaataaggtc

SEQ ID NO: 515 - DNA, 20 bp, Artificial Sequence
  Description of Artificial Sequence: Synthetic probe
aaactgctatggacatggag

SEQ ID NO: 516 - DNA, 20 bp, Artificial Sequence
  Description of Artificial Sequence: Synthetic probe
gtcagatgggaacttggaac

SEQ ID NO: 517 - DNA, 20 bp, Artificial Sequence
  Description of Artificial Sequence: Synthetic probe
gcaaacaggcattctcacag

SEQ ID NO: 518 - DNA, 20 bp, Artificial Sequence
  Description of Artificial Sequence: Synthetic probe
ctgggtttatagtctttggg

SEQ ID NO: 519 - DNA, 20 bp, Artificial Sequence
  Description of Artificial Sequence: Synthetic probe
gtcctgactcactaaagatg

SEQ ID NO: 520 - DNA, 20 bp, Artificial Sequence
  Description of Artificial Sequence: Synthetic probe
ccaggatattggggctgagg

SEQ ID NO: 521 - DNA, 20 bp, Artificial Sequence
  Description of Artificial Sequence: Synthetic probe
cgcatgtcgctggtgaagag

SEQ ID NO: 522 - DNA, 20 bp, Artificial Sequence
  Description of Artificial Sequence: Synthetic probe
gaggtttgccacagggatgt

SEQ ID NO: 523 - DNA, 20 bp, Artificial Sequence
  Description of Artificial Sequence: Synthetic probe
cactttcatacgcaggcatc

SEQ ID NO: 524 - DNA, 20 bp, Artificial Sequence
  Description of Artificial Sequence: Synthetic probe
tcttgttacctacatctaag

SEQ ID NO: 525 - DNA, 20 bp, Artificial Sequence
  Description of Artificial Sequence: Synthetic probe
ttctggacaccaactgtgtc

SEQ ID NO: 526 - DNA, 20 bp, Artificial Sequence
  Description of Artificial Sequence: Synthetic probe
ctgtgaatgtatcgctactg

SEQ ID NO: 527 - DNA, 20 bp, Artificial Sequence
  Description of Artificial Sequence: Synthetic probe
ccctttgcattcacagagag

SEQ ID NO: 528 - DNA, 20 bp, Artificial Sequence
  Description of Artificial Sequence: Synthetic probe
gtcattggttatagagactt

SEQ ID NO: 529 - DNA, 20 bp, Artificial Sequence
  Description of Artificial Sequence: Synthetic probe
aagctcgatgggttctggag

SEQ ID NO: 530 - DNA, 20 bp, Artificial Sequence
  Description of Artificial Sequence: Synthetic probe
gacagtgtggcttgtcacag

SEQ ID NO: 531 - DNA, 20 bp, Artificial Sequence
  Description of Artificial Sequence: Synthetic probe
gtgcctgtttgaagctactg

SEQ ID NO: 532 - DNA, 20 bp, Artificial Sequence
  Description of Artificial Sequence: Synthetic probe
ctgcctccatttctgggaaa

SEQ ID NO: 533 - DNA, 20 bp, Artificial Sequence
  Description of Artificial Sequence: Synthetic probe
tatgacgtggtcagggtgtc

SEQ ID NO: 534 - DNA, 20 bp, Artificial Sequence
  Description of Artificial Sequence: Synthetic probe
cattcctaatcatggggcag

SEQ ID NO: 535 - DNA, 20 bp, Artificial Sequence
  Description of Artificial Sequence: Synthetic probe
accaaatcagaacagctcag

SEQ ID NO: 536 - DNA, 20 bp, Artificial Sequence
  Description of Artificial Sequence: Synthetic probe
caacccctgaatttgacagt

SEQ ID NO: 537 - DNA, 20 bp, Artificial Sequence
  Description of Artificial Sequence: Synthetic probe
tccgtggaaccagtcctagc

SEQ ID NO: 538 - DNA, 20 bp, Artificial Sequence
  Description of Artificial Sequence: Synthetic probe
cgcgtgtgacagtcttgcat

SEQ ID NO: 539 - DNA, 20 bp, Artificial Sequence
  Description of Artificial Sequence: Synthetic probe
ggaattggtgtccctgttag

SEQ ID NO: 540 - DNA, 20 bp, Artificial Sequence
  Description of Artificial Sequence: Synthetic probe
caatggcagagaccagcctg

SEQ ID NO: 541 - DNA, 20 bp, Artificial Sequence
  Description of Artificial Sequence: Synthetic probe
ctggtctgtaccccagggag

SEQ ID NO: 542 - DNA, 20 bp, Artificial Sequence
  Description of Artificial Sequence: Synthetic probe
cgggtgcttgtactgtgtga

SEQ ID NO: 543 - DNA, 20 bp, Artificial Sequence
  Description of Artificial Sequence: Synthetic probe
gctggtcacacgtggatctg

SEQ ID NO: 544 - DNA, 20 bp, Artificial Sequence
  Description of Artificial Sequence: Synthetic probe
gtttatgaatgcatttggga

SEQ ID NO: 545 - DNA, 20 bp, Artificial Sequence
  Description of Artificial Sequence: Synthetic probe
tgggctttctaaagaggctg

SEQ ID NO: 546 - DNA, 20 bp, Artificial Sequence
  Description of Artificial Sequence: Synthetic probe
cgggaagccatcctccactc

SEQ ID NO: 547 - DNA, 20 bp, Artificial Sequence
  Description of Artificial Sequence: Synthetic probe
gcagcacaatagtaccgatc

SEQ ID NO: 548 - DNA, 20 bp, Artificial Sequence
  Description of Artificial Sequence: Synthetic probe
agttaactcagcgctgaagg

SEQ ID NO: 549 - DNA, 20 bp, Artificial Sequence
  Description of Artificial Sequence: Synthetic probe
gcatgtaataatacaagaac

SEQ ID NO: 550 - DNA, 20 bp, Artificial Sequence
  Description of Artificial Sequence: Synthetic probe
tgtttccccctcaaaacctg

SEQ ID NO: 551 - DNA, 20 bp, Artificial Sequence
  Description of Artificial Sequence: Synthetic probe
actgcaccaagtctcactgg

SEQ ID NO: 552 - DNA, 20 bp, Artificial Sequence
  Description of Artificial Sequence: Synthetic probe
ctgtcagtatgacatttcac

SEQ ID NO: 553 - DNA, 20 bp, Artificial Sequence
  Description of Artificial Sequence: Synthetic probe
tgagataaaacgatctaaag

SEQ ID NO: 554 - DNA, 20 bp, Artificial Sequence
  Description of Artificial Sequence: Synthetic probe
gtaggcagaccctggaccca

SEQ ID NO: 555 - DNA, 20 bp, Artificial Sequence
  Description of Artificial Sequence: Synthetic probe
gaaccttgactctcttgatg

SEQ ID NO: 556 - DNA, 20 bp, Artificial Sequence
  Description of Artificial Sequence: Synthetic probe
gaacacagatgggctgcttg

SEQ ID NO: 557 - DNA, 20 bp, Artificial Sequence
  Description of Artificial Sequence: Synthetic probe
tgtccttggttcttaaaagc

SEQ ID NO: 558 - DNA, 20 bp, Artificial Sequence
  Description of Artificial Sequence: Synthetic probe
attctgtactaatacagctc

SEQ ID NO: 559 - DNA, 20 bp, Artificial Sequence
  Description of Artificial Sequence: Synthetic probe
tttcctctctctggcccttg

SEQ ID NO: 560 - DNA, 20 bp, Artificial Sequence
  Description of Artificial Sequence: Synthetic probe
ggtcctgggaatgctgctgc

SEQ ID NO: 561 - DNA, 20 bp, Artificial Sequence
  Description of Artificial Sequence: Synthetic probe
gggagctggggctgaagttg

SEQ ID NO: 562 - DNA, 20 bp, Artificial Sequence
  Description of Artificial Sequence: Synthetic probe
ctctgtacccatgaactccc

SEQ ID NO: 563 - DNA, 20 bp, Artificial Sequence
  Description of Artificial Sequence: Synthetic probe
ctagaattgattctcctttc

SEQ ID NO: 564 - DNA, 20 bp, Artificial Sequence
  Description of Artificial Sequence: Synthetic probe
ctgagttttactccacggag

SEQ ID NO: 565 - DNA, 20 bp, Artificial Sequence
  Description of Artificial Sequence: Synthetic probe
gccatgcgttgtagctgatg

SEQ ID NO: 566 - DNA, 20 bp, Artificial Sequence
  Description of Artificial Sequence: Synthetic probe
gtctccgtgtaagccaaagg

SEQ ID NO: 567 - DNA, 20 bp, Artificial Sequence
  Description of Artificial Sequence: Synthetic probe
aaccactgtgttttatctac

SEQ ID NO: 568 - DNA, 20 bp, Artificial Sequence
  Description of Artificial Sequence: Synthetic probe
tgtgtgttgtggtggcctgt

SEQ ID NO: 569 - DNA, 20 bp, Artificial Sequence
  Description of Artificial Sequence: Synthetic probe
gggcaggcctgcaaatactg

SEQ ID NO: 570 - DNA, 20 bp, Artificial Sequence
  Description of Artificial Sequence: Synthetic probe
gcacagagcattaatcatac

SEQ ID NO: 571 - DNA, 20 bp, Artificial Sequence
  Description of Artificial Sequence: Synthetic probe
gacataaatggtgctggtag

SEQ ID NO: 572 - DNA, 20 bp, Artificial Sequence
  Description of Artificial Sequence: Synthetic probe
gaggttatcagagtaaggaa

SEQ ID NO: 573 - DNA, 20 bp, Artificial Sequence
  Description of Artificial Sequence: Synthetic probe
ggggcagtggtggttttctg

SEQ ID NO: 574 - DNA, 20 bp, Artificial Sequence
  Description of Artificial Sequence: Synthetic probe
ttctttctggctatgcattt

SEQ ID NO: 575 - DNA, 20 bp, Artificial Sequence
  Description of Artificial Sequence: Synthetic probe
tgggcggctactggaggagg

SEQ ID NO: 576 - DNA, 20 bp, Artificial Sequence
  Description of Artificial Sequence: Synthetic probe
ctgtgaggaagaaggggtcg

SEQ ID NO: 577 - DNA, 20 bp, Artificial Sequence
  Description of Artificial Sequence: Synthetic probe
atgacaagcttatgcttctc

SEQ ID NO: 578 - DNA, 20 bp, Artificial Sequence
  Description of Artificial Sequence: Synthetic probe
ctggaaataaacaagctaat

SEQ ID NO: 579 - DNA, 20 bp, Artificial Sequence
  Description of Artificial Sequence: Synthetic probe
tcgggcccgggggcctgagc

SEQ ID NO: 580 - DNA, 20 bp, Artificial Sequence
  Description of Artificial Sequence: Synthetic probe
ctgggaccccaccccgtgtt

SEQ ID NO: 581 - DNA, 20 bp, Artificial Sequence
  Description of Artificial Sequence: Synthetic probe
tgctggtccccatctttgcc

SEQ ID NO: 582 - DNA, 20 bp, Artificial Sequence
  Description of Artificial Sequence: Synthetic probe
gcctttgccgtgatgaccgt

SEQ ID NO: 583 - DNA, 20 bp, Artificial Sequence
  Description of Artificial Sequence: Synthetic probe
ttagcgtctttgaaggagac

SEQ ID NO: 584 - DNA, 20 bp, Artificial Sequence
  Description of Artificial Sequence: Synthetic probe
cagacatgagtgaataccta

SEQ ID NO: 585 - DNA, 20 bp, Artificial Sequence
  Description of Artificial Sequence: Synthetic probe
ttatgaactcctgtgtattg

SEQ ID NO: 586 - DNA, 20 bp, Artificial Sequence
  Description of Artificial Sequence: Synthetic probe
caatggtatgaatctgctca

SEQ ID NO: 587 - DNA, 20 bp, Artificial Sequence
  Description of Artificial Sequence: Synthetic probe
tcctatttctcaggcttgag

SEQ ID NO: 588 - DNA, 20 bp, Artificial Sequence
  Description of Artificial Sequence: Synthetic probe
caagttggtatctgctcagg

SEQ ID NO: 589 - DNA, 20 bp, Artificial Sequence
  Description of Artificial Sequence: Synthetic probe
tggctttgtgcactcagatg

SEQ ID NO: 590 - DNA, 20 bp, Artificial Sequence
  Description of Artificial Sequence: Synthetic probe
gcaccatcagccatcatgac

SEQ ID NO: 591 - DNA, 20 bp, Artificial Sequence
  Description of Artificial Sequence: Synthetic probe
accagagcacctccaaactg

SEQ ID NO: 592 - DNA, 20 bp, Artificial Sequence
  Description of Artificial Sequence: Synthetic probe
cattgaggagaagttccaga

SEQ ID NO: 593 - DNA, 20 bp, Artificial Sequence
  Description of Artificial Sequence: Synthetic probe
gcttaaacattctccgcctc

SEQ ID NO: 594 - DNA, 20 bp, Artificial Sequence
  Description of Artificial Sequence: Synthetic probe
cagggtgcagattcagagct

SEQ ID NO: 595 - DNA, 20 bp, Artificial Sequence
  Description of Artificial Sequence: Synthetic probe
tggttacaagaaagttatac

SEQ ID NO: 596 - DNA, 20 bp, Artificial Sequence
  Description of Artificial Sequence: Synthetic probe
catttaaagctggcaccaga

SEQ ID NO: 597 - DNA, 20 bp, Artificial Sequence
  Description of Artificial Sequence: Synthetic probe
aggattgtgagagacaaaat

SEQ ID NO: 598 - DNA, 20 bp, Artificial Sequence
  Description of Artificial Sequence: Synthetic probe
gacaggcatcggcaaagggt

SEQ ID NO: 599 - DNA, 20 bp, Artificial Sequence
  Description of Artificial Sequence: Synthetic probe
tcttttaacaggagcctgag

SEQ ID NO: 600 - DNA, 20 bp, Artificial Sequence
  Description of Artificial Sequence: Synthetic probe
cacaaggtttaatgaggaag

SEQ ID NO: 601 - DNA, 20 bp, Artificial Sequence
  Description of Artificial Sequence: Synthetic probe
tgacatggcgggacccaagg

SEQ ID NO: 602 - DNA, 20 bp, Artificial Sequence
  Description of Artificial Sequence: Synthetic probe
ccaccaagagcccagaagaa

SEQ ID NO: 603 - DNA, 20 bp, Artificial Sequence
  Description of Artificial Sequence: Synthetic probe
gcctgcaacattcggccgtg

SEQ ID NO: 604 - DNA, 20 bp, Artificial Sequence
  Description of Artificial Sequence: Synthetic probe
gttacgatgagtttacccct

SEQ ID NO: 605 - DNA, 20 bp, Artificial Sequence
  Description of Artificial Sequence: Synthetic probe
tgactctgaaatctgaagac

SEQ ID NO: 606 - DNA, 20 bp, Artificial Sequence
  Description of Artificial Sequence: Synthetic probe
ctcgagcagatgatgccaac

SEQ ID NO: 607 - DNA, 20 bp, Artificial Sequence
  Description of Artificial Sequence: Synthetic probe
cttttgtagaagtcacattc

SEQ ID NO: 608 - DNA, 20 bp, Artificial Sequence
  Description of Artificial Sequence: Synthetic probe
ctgaacaggatattctcaca

SEQ ID NO: 609 - DNA, 20 bp, Artificial Sequence
  Description of Artificial Sequence: Synthetic probe
agtcttttttgccgagaaag

SEQ ID NO: 610 - DNA, 20 bp, Artificial Sequence
  Description of Artificial Sequence: Synthetic probe
cacagtagtctgggactggg

SEQ ID NO: 611 - DNA, 20 bp, Artificial Sequence
  Description of Artificial Sequence: Synthetic probe
cagtcccaggtcccagctcc

SEQ ID NO: 612 - DNA, 20 bp, Artificial Sequence
  Description of Artificial Sequence: Synthetic probe
cctcttatggtttctgtcat

SEQ ID NO: 613 - DNA, 20 bp, Artificial Sequence
  Description of Artificial Sequence: Synthetic probe
gcagtgagctctgtcttccc

SEQ ID NO: 614 - DNA, 20 bp, Artificial Sequence
  Description of Artificial Sequence: Synthetic probe
ccacctgcctagcccatcat

SEQ ID NO: 615 - DNA, 20 bp, Artificial Sequence
  Description of Artificial Sequence: Synthetic probe
ttttccttcccaggtgcagc

SEQ ID NO: 616 - DNA, 20 bp, Artificial Sequence
  Description of Artificial Sequence: Synthetic probe
ctgtgattctgatggggact

SEQ ID NO: 617 - DNA, 20 bp, Artificial Sequence
  Description of Artificial Sequence: Synthetic probe
aggaatggctggtccagagg

SEQ ID NO: 618 - DNA, 20 bp, Artificial Sequence
  Description of Artificial Sequence: Synthetic probe
cttttgtccactccctctca

SEQ ID NO: 619 - DNA, 20 bp, Artificial Sequence
  Description of Artificial Sequence: Synthetic probe
atgcctcctgggtgctgaac

SEQ ID NO: 620 - DNA, 20 bp, Artificial Sequence
  Description of Artificial Sequence: Synthetic probe
gttgcattctgtcctgatga

SEQ ID NO: 621 - DNA, 20 bp, Artificial Sequence
  Description of Artificial Sequence: Synthetic probe
gtcggggtggagactcgcag

SEQ ID NO: 622 - DNA, 20 bp, Artificial Sequence
  Description of Artificial Sequence: Synthetic probe
cagctgctacccacagccta

SEQ ID NO: 623 - DNA, 20 bp, Artificial Sequence
  Description of Artificial Sequence: Synthetic probe
ggtatacttgtgtgaaagtg

SEQ ID NO: 624 - DNA, 20 bp, Artificial Sequence
  Description of Artificial Sequence: Synthetic probe
gctggttgggagcagagcta

SEQ ID NO: 625 - DNA, 20 bp, Artificial Sequence
  Description of Artificial Sequence: Synthetic probe
gtgttagcccccacatgggg

SEQ ID NO: 626 - DNA, 20 bp, Artificial Sequence
  Description of Artificial Sequence: Synthetic probe
ctgctcttgcttctactaaa

SEQ ID NO: 627 - DNA, 20 bp, Artificial Sequence
  Description of Artificial Sequence: Synthetic probe
tgctccagaaaatgacagac

SEQ ID NO: 628 - DNA, 20 bp, Artificial Sequence
  Description of Artificial Sequence: Synthetic probe
ctcagacagattgtcacgga

SEQ ID NO: 629 - DNA, 20 bp, Artificial Sequence
  Description of Artificial Sequence: Synthetic probe
gagacttatagccacacaac

SEQ ID NO: 630 - DNA, 20 bp, Artificial Sequence
  Description of Artificial Sequence: Synthetic probe
caatctctgcttcagactct

SEQ ID NO: 631 - DNA, 20 bp, Artificial Sequence
  Description of Artificial Sequence: Synthetic probe
cgcttcagtaacaagtgttg

SEQ ID NO: 632 - DNA, 20 bp, Artificial Sequence
  Description of Artificial Sequence: Synthetic probe
gcaaacgagactttctcctg

SEQ ID NO: 633 - DNA, 20 bp, Artificial Sequence
  Description of Artificial Sequence: Synthetic probe
atatgctaaatcacattcag

SEQ ID NO: 634 - DNA, 20 bp, Artificial Sequence
  Description of Artificial Sequence: Synthetic probe
catgtgtattttgacattta

SEQ ID NO: 635 - DNA, 20 bp, Artificial Sequence
  Description of Artificial Sequence: Synthetic probe
ggcagtctttgtcgttgttc

SEQ ID NO: 636 - DNA, 20 bp, Artificial Sequence
  Description of Artificial Sequence: Synthetic probe
attctggggataaaggggaa

SEQ ID NO: 637 - DNA, 20 bp, Artificial Sequence
  Description of Artificial Sequence: Synthetic probe
tgcatctccaaaattacaac

SEQ ID NO: 638 - DNA, 20 bp, Artificial Sequence
  Description of Artificial Sequence: Synthetic probe
ggttggccgatcccatttga

SEQ ID NO: 639 - DNA, 20 bp, Artificial Sequence
  Description of Artificial Sequence: Synthetic probe
cctgccagtcatgaatctca

SEQ ID NO: 640 - DNA, 20 bp, Artificial Sequence
  Description of Artificial Sequence: Synthetic probe
gacagcctgccacctattgc

SEQ ID NO: 641 - DNA, 20 bp, Artificial Sequence
  Description of Artificial Sequence: Synthetic probe
gaaggcagagatctaacctg

SEQ ID NO: 642 - DNA, 20 bp, Artificial Sequence
  Description of Artificial Sequence: Synthetic probe
gcttgtttagggccatacca

SEQ ID NO: 643 - DNA, 20 bp, Artificial Sequence
  Description of Artificial Sequence: Synthetic probe
aggtgggggtgtcagaggag

SEQ ID NO: 644 - DNA, 20 bp, Artificial Sequence
  Description of Artificial Sequence: Synthetic probe
gcaaaggggtcccagctgcg

SEQ ID NO: 645 - DNA, 20 bp, Artificial Sequence
  Description of Artificial Sequence: Synthetic probe
tttttctccacttctaaatg

SEQ ID NO: 646 - DNA, 20 bp, Artificial Sequence
  Description of Artificial Sequence: Synthetic probe
gttcctggttcctttcttcc

SEQ ID NO: 647 - DNA, 20 bp, Artificial Sequence
  Description of Artificial Sequence: Synthetic probe
tatcatctccggttcgatcg

SEQ ID NO: 648 - DNA, 20 bp, Artificial Sequence
  Description of Artificial Sequence: Synthetic probe
cgtccagatggaaaacggaa

SEQ ID NO: 649 - DNA, 20 bp, Artificial Sequence
  Description of Artificial Sequence: Synthetic probe
aagtacgcaacttacttttc

SEQ ID NO: 650 - DNA, 20 bp, Artificial Sequence
  Description of Artificial Sequence: Synthetic probe
caccaaagaactgtcagcag

SEQ ID NO: 651 - DNA, 20 bp, Artificial Sequence
  Description of Artificial Sequence: Synthetic probe
ccttgattcagtgctcagtg

SEQ ID NO: 652 - DNA, 20 bp, Artificial Sequence
  Description of Artificial Sequence: Synthetic probe
gtctcctagtaagaagtcac

SEQ ID NO: 653 - DNA, 20 bp, Artificial Sequence
  Description of Artificial Sequence: Synthetic probe
ggtgccatgtctgggaacag

SEQ ID NO: 654 - DNA, 20 bp, Artificial Sequence
  Description of Artificial Sequence: Synthetic probe
ggacgggggagcttcacctt

SEQ ID NO: 655 - DNA, 20 bp, Artificial Sequence
  Description of Artificial Sequence: Synthetic probe
ttcctcaacagggcattatc

SEQ ID NO: 656 - DNA, 20 bp, Artificial Sequence
  Description of Artificial Sequence: Synthetic probe
cgctccctgaatgtccatgt

SEQ ID NO: 657 - DNA, 20 bp, Artificial Sequence
  Description of Artificial Sequence: Synthetic probe
cactggaacttcttgagcag

SEQ ID NO: 658 - DNA, 20 bp, Artificial Sequence
  Description of Artificial Sequence: Synthetic probe
gagcatacccagggcttcat

SEQ ID NO: 659 - DNA, 20 bp, Artificial Sequence
  Description of Artificial Sequence: Synthetic probe
tgtttcccctctcagcatcg

SEQ ID NO: 660 - DNA, 20 bp, Artificial Sequence
  Description of Artificial Sequence: Synthetic probe
cttttgctgggccgtgatcg

SEQ ID NO: 661 - DNA, 20 bp, Artificial Sequence
  Description of Artificial Sequence: Synthetic probe
tattcccaaatgtctctatc

SEQ ID NO: 662 - DNA, 20 bp, Artificial Sequence
  Description of Artificial Sequence: Synthetic probe
cttttgactggagcatcttc

SEQ ID NO: 663 - DNA, 20 bp, Artificial Sequence
  Description of Artificial Sequence: Synthetic probe
cattcagtgccacggtttag

SEQ ID NO: 664 - DNA, 20 bp, Artificial Sequence
  Description of Artificial Sequence: Synthetic probe
gtgaagtcgctgcatatgtg

SEQ ID NO: 665 - DNA, 20 bp, Artificial Sequence
  Description of Artificial Sequence: Synthetic probe
tgtctggagcagagggagac

SEQ ID NO: 666 - DNA, 20 bp, Artificial Sequence
  Description of Artificial Sequence: Synthetic probe
catactagggcgactcctgt

SEQ ID NO: 667 - DNA, 20 bp, Artificial Sequence
  Description of Artificial Sequence: Synthetic probe
caatccatcttctgtaattg

SEQ ID NO: 668 - DNA, 20 bp, Artificial Sequence
  Description of Artificial Sequence: Synthetic probe
ctgtatagattgtcatcata

SEQ ID NO: 669 - DNA, 20 bp, Artificial Sequence
  Description of Artificial Sequence: Synthetic probe
ggtggtgatggattttgtag

SEQ ID NO: 670 - DNA, 20 bp, Artificial Sequence
  Description of Artificial Sequence: Synthetic probe
cttgctgcttgtttcaccac

SEQ ID NO: 671 - DNA, 20 bp, Artificial Sequence
  Description of Artificial Sequence: Synthetic probe
cacagacagtttctgacagg

SEQ ID NO: 672 - DNA, 20 bp, Artificial Sequence
  Description of Artificial Sequence: Synthetic probe
cgcaactcctccattttcct

SEQ ID NO: 673 - DNA, 20 bp, Artificial Sequence
  Description of Artificial Sequence: Synthetic probe
atggatcagaggcacaagtg

SEQ ID NO: 674 - DNA, 20 bp, Artificial Sequence
  Description of Artificial Sequence: Synthetic probe
cagaggctgtggtcatgcgg

SEQ ID NO: 675 - DNA, 20 bp, Artificial Sequence
  Description of Artificial Sequence: Synthetic probe
tgctgggcaaacaggccatc

SEQ ID NO: 676 - DNA, 20 bp, Artificial Sequence
  Description of Artificial Sequence: Synthetic probe
gatgatgactgtaaccagac

SEQ ID NO: 677 - DNA, 20 bp, Artificial Sequence
  Description of Artificial Sequence: Synthetic probe
agaagatgcaggacaagtag

SEQ ID NO: 678 - DNA, 20 bp, Artificial Sequence
  Description of Artificial Sequence: Synthetic probe
gactggaaggtccttgcctg

SEQ ID NO: 679 - DNA, 20 bp, Artificial Sequence
  Description of Artificial Sequence: Synthetic probe
ccctgtttcctgttgatatg

SEQ ID NO: 680 - DNA, 20 bp, Artificial Sequence
  Description of Artificial Sequence: Synthetic probe
gtgatagttggagagtcaaa

SEQ ID NO: 681 - DNA, 20 bp, Artificial Sequence
  Description of Artificial Sequence: Synthetic probe
tgatcaccttgcatggacag

SEQ ID NO: 682 - DNA, 20 bp, Artificial Sequence
  Description of Artificial Sequence: Synthetic probe
caatcctgtaaacatcacag

SEQ ID NO: 683 - DNA, 20 bp, Artificial Sequence
  Description of Artificial Sequence: Synthetic probe
atcagtggccctcataactg

SEQ ID NO: 684 - DNA, 20 bp, Artificial Sequence
  Description of Artificial Sequence: Synthetic probe
gagtagagttcctggttgct

SEQ ID NO: 685 - DNA, 20 bp, Artificial Sequence
  Description of Artificial Sequence: Synthetic probe
ctacccctttgcacttgtgg

SEQ ID NO: 686 - DNA, 20 bp, Artificial Sequence
  Description of Artificial Sequence: Synthetic probe
caacagataagtttgcagtt

SEQ ID NO: 687 - DNA, 20 bp, Artificial Sequence
  Description of Artificial Sequence: Synthetic probe
ggtccaatctgctctcaagg

SEQ ID NO: 688 - DNA, 20 bp, Artificial Sequence
  Description of Artificial Sequence: Synthetic probe
ccttggtcctggtgggattc

SEQ ID NO: 689 - DNA, 20 bp, Artificial Sequence
  Description of Artificial Sequence: Synthetic probe
agctaagtttcccgttaaag

SEQ ID NO: 690 - DNA, 20 bp, Artificial Sequence
  Description of Artificial Sequence: Synthetic probe
ggaagtgctttgaagatgtg

SEQ ID NO: 691 - DNA, 20 bp, Artificial Sequence
  Description of Artificial Sequence: Synthetic probe
ttgctggcacagtagtttac

SEQ ID NO: 692 - DNA, 20 bp, Artificial Sequence
  Description of Artificial Sequence: Synthetic probe
cctgttatctgtgtttcata

SEQ ID NO: 693 - DNA, 20 bp, Artificial Sequence
  Description of Artificial Sequence: Synthetic probe
ttgtcatgactctgagtcac

SEQ ID NO: 694 - DNA, 20 bp, Artificial Sequence
  Description of Artificial Sequence: Synthetic probe
gtgctgctgtattgcaacgt

SEQ ID NO: 695 - DNA, 20 bp, Artificial Sequence
  Description of Artificial Sequence: Synthetic probe
acaatgaagcccagtgtaac

SEQ ID NO: 696 - DNA, 20 bp, Artificial Sequence
  Description of Artificial Sequence: Synthetic probe
gtcagtccacagaaatagcc

SEQ ID NO: 697 - DNA, 20 bp, Artificial Sequence
  Description of Artificial Sequence: Synthetic probe
acgtctcggattgcccctcg

SEQ ID NO: 698 - DNA, 20 bp, Artificial Sequence
  Description of Artificial Sequence: Synthetic probe
gtctttctggatgactctgc

SEQ ID NO: 699 - DNA, 20 bp, Artificial Sequence
  Description of Artificial Sequence: Synthetic probe
gcaccctcgtggggttaagg

SEQ ID NO: 700 - DNA, 20 bp, Artificial Sequence
  Description of Artificial Sequence: Synthetic probe
cgagctgttcctggtttaaa

SEQ ID NO: 701 - DNA, 20 bp, Artificial Sequence
  Description of Artificial Sequence: Synthetic probe
tgaaacacctcgttttgaag

SEQ ID NO: 702 - DNA, 20 bp, Artificial Sequence
  Description of Artificial Sequence: Synthetic probe
gtgaatctttggttttctcc

SEQ ID NO: 703 - DNA, 20 bp, Artificial Sequence
  Description of Artificial Sequence: Synthetic probe
tccatgtaacaaaagatctg

SEQ ID NO: 704 - DNA, 20 bp, Artificial Sequence
  Description of Artificial Sequence: Synthetic probe
gaagtcaccctcctctggcc

SEQ ID NO: 705 - DNA, 20 bp, Artificial Sequence
  Description of Artificial Sequence: Synthetic probe
ctgtcattgcagccggactc

SEQ ID NO: 706 - DNA, 20 bp, Artificial Sequence
  Description of Artificial Sequence: Synthetic probe
cagatgcatttatttcaagt

SEQ ID NO: 707 - DNA, 20 bp, Artificial Sequence
  Description of Artificial Sequence: Synthetic probe
accccacgcaagttcctgag

SEQ ID NO: 708 - DNA, 20 bp, Artificial Sequence
  Description of Artificial Sequence: Synthetic probe
ctgaacatggagcaagggga

SEQ ID NO: 709 - DNA, 20 bp, Artificial Sequence
  Description of Artificial Sequence: Synthetic probe
atctcaaaaagcaacttctg

SEQ ID NO: 710 - DNA, 20 bp, Artificial Sequence
  Description of Artificial Sequence: Synthetic probe
ccctgcaacgccccccactc

SEQ ID NO: 711 - DNA, 20 bp, Artificial Sequence
  Description of Artificial Sequence: Synthetic probe
ctctcctaagagccttcatg

SEQ ID NO: 712 - DNA, 20 bp, Artificial Sequence
  Description of Artificial Sequence: Synthetic probe
cacacccctgaaccacgagg

SEQ ID NO: 713 - DNA, 20 bp, Artificial Sequence
  Description of Artificial Sequence: Synthetic probe
gttccctccaaacctcccag

SEQ ID NO: 714 - DNA, 20 bp, Artificial Sequence
  Description of Artificial Sequence: Synthetic probe
ccactcgggcttgtaactgt

SEQ ID NO: 715 - DNA, 20 bp, Artificial Sequence
  Description of Artificial Sequence: Synthetic probe
ggatagaagggtttgcaatg

SEQ ID NO: 716 - DNA, 20 bp, Artificial Sequence
  Description of Artificial Sequence: Synthetic probe
ccatattattggtggagggc

SEQ ID NO: 717 - DNA, 20 bp, Artificial Sequence
  Description of Artificial Sequence: Synthetic probe
tgtgtgaagccgtttgtgtg

SEQ ID NO: 718 - DNA, 20 bp, Artificial Sequence
  Description of Artificial Sequence: Synthetic probe
gtctccatgtaggtgctgtg

SEQ ID NO: 719 - DNA, 20 bp, Artificial Sequence
  Description of Artificial Sequence: Synthetic probe
taaggggccggcctcgctgc

SEQ ID NO: 720 - DNA, 20 bp, Artificial Sequence
  Description of Artificial Sequence: Synthetic probe
gctgattcgtcgagcccatc

SEQ ID NO: 721 - DNA, 20 bp, Artificial Sequence
  Description of Artificial Sequence: Synthetic probe
ctcaaatactgttgtgtctg

SEQ ID NO: 722 - DNA, 20 bp, Artificial Sequence
  Description of Artificial Sequence: Synthetic probe
caccagtcttttagtgtctc

SEQ ID NO: 723 - DNA, 20 bp, Artificial Sequence
  Description of Artificial Sequence: Synthetic probe
gggcccctatccactggcag

SEQ ID NO: 724 - DNA, 20 bp, Artificial Sequence
  Description of Artificial Sequence: Synthetic probe
cagctttattctcagtagcg

SEQ ID NO: 725 - DNA, 20 bp, Artificial Sequence
  Description of Artificial Sequence: Synthetic probe
caccttagcaacaatgggag

SEQ ID NO: 726 - DNA, 20 bp, Artificial Sequence
  Description of Artificial Sequence: Synthetic probe
ctgtgggagtgattttggcc

SEQ ID NO: 727 - DNA, 20 bp, Artificial Sequence
  Description of Artificial Sequence: Synthetic probe
ccagagttgcatgtagatag

SEQ ID NO: 728 - DNA, 20 bp, Artificial Sequence
  Description of Artificial Sequence: Synthetic probe
catttatttctgtgccctta

SEQ ID NO: 729 - DNA, 20 bp, Artificial Sequence
  Description of Artificial Sequence: Synthetic probe
tttgcctcaaacctcttacg

SEQ ID NO: 730 - DNA, 20 bp, Artificial Sequence
  Description of Artificial Sequence: Synthetic probe
gagcttctcctcagaagtgg

SEQ ID NO: 731 - DNA, 20 bp, Artificial Sequence
  Description of Artificial Sequence: Synthetic probe
tgtggccttgagtaaatccc

SEQ ID NO: 732 - DNA, 20 bp, Artificial Sequence
  Description of Artificial Sequence: Synthetic probe
gttacctctctgagcctcgg

SEQ ID NO: 733 - DNA, 20 bp, Artificial Sequence
  Description of Artificial Sequence: Synthetic probe
cctcacaacctgtccttcac

SEQ ID NO: 734 - DNA, 20 bp, Artificial Sequence
  Description of Artificial Sequence: Synthetic probe
ctagtccctcctgacccagg

SEQ ID NO: 735 - DNA, 20 bp, Artificial Sequence
  Description of Artificial Sequence: Synthetic probe
taggcagttcctgactgttc

SEQ ID NO: 736 - DNA, 20 bp, Artificial Sequence
  Description of Artificial Sequence: Synthetic probe
cacatgtagtacattgtacc

SEQ ID NO: 737 - DNA, 20 bp, Artificial Sequence
  Description of Artificial Sequence: Synthetic probe
catttctgtgatgtgttggg

SEQ ID NO: 738 - DNA, 20 bp, Artificial Sequence
  Description of Artificial Sequence: Synthetic probe
cgtggttggaaggtgggttc

SEQ ID NO: 739 - DNA, 20 bp, Artificial Sequence
  Description of Artificial Sequence: Synthetic probe
ctggtctctgcacacatatg

SEQ ID NO: 740 - DNA, 20 bp, Artificial Sequence
  Description of Artificial Sequence: Synthetic probe
cttggttacttgcatgcatt

SEQ ID NO: 741 - DNA, 20 bp, Artificial Sequence
  Description of Artificial Sequence: Synthetic probe
tgttctacgccccttggtgc

SEQ ID NO: 742 - DNA, 20 bp, Artificial Sequence
  Description of Artificial Sequence: Synthetic probe
ccacactgtaagaaggtcat

SEQ ID NO: 743 - DNA, 20 bp, Artificial Sequence
  Description of Artificial Sequence: Synthetic probe
actgcggaatgtggcctctg

SEQ ID NO: 744 - DNA, 20 bp, Artificial Sequence
  Description of Artificial Sequence: Synthetic probe
cttcctccgtcctcctgccc

SEQ ID NO: 745 - DNA, 20 bp, Artificial Sequence
  Description of Artificial Sequence: Synthetic probe
aaaatccagaaatagagctg

SEQ ID NO: 746 - DNA, 20 bp, Artificial Sequence
  Description of Artificial Sequence: Synthetic probe
cttcgcctagaactggccga

SEQ ID NO: 747 - DNA, 20 bp, Artificial Sequence
  Description of Artificial Sequence: Synthetic probe
aggacatctgactcccctac

SEQ ID NO: 748 - DNA, 20 bp, Artificial Sequence
  Description of Artificial Sequence: Synthetic probe
ctctttatgtctgcccagtg

SEQ ID NO: 749 - DNA, 20 bp, Artificial Sequence
  Description of Artificial Sequence: Synthetic probe
cttgaagatggacagaaaag

SEQ ID NO: 750 - DNA, 20 bp, Artificial Sequence
  Description of Artificial Sequence: Synthetic probe
ctgtggagacccacctgctc

SEQ ID NO: 751 - DNA, 20 bp, Artificial Sequence
  Description of Artificial Sequence: Synthetic probe
ggatgtgtgatgtttatatg

SEQ ID NO: 752 - DNA, 20 bp, Artificial Sequence
  Description of Artificial Sequence: Synthetic probe
ggagaacaaaaagctgatgt

SEQ ID NO: 753 - DNA, 20 bp, Artificial Sequence
  Description of Artificial Sequence: Synthetic probe
ttggaaaatactacctactg

SEQ ID NO: 754 - DNA, 20 bp, Artificial Sequence
  Description of Artificial Sequence: Synthetic probe
gtttgggagatgtatatagt

SEQ ID NO: 755 - DNA, 20 bp, Artificial Sequence
  Description of Artificial Sequence: Synthetic probe
tccaaggcatcaacctcgtc

SEQ ID NO: 756 - DNA, 20 bp, Artificial Sequence
  Description of Artificial Sequence: Synthetic probe
caggcaaagaagctggtgga

SEQ ID NO: 757 - DNA, 20 bp, Artificial Sequence
  Description of Artificial Sequence: Synthetic probe
cctgtcagaagggggttgtg

SEQ ID NO: 758 - DNA, 20 bp, Artificial Sequence
  Description of Artificial Sequence: Synthetic probe
gcaaaagccacattacaagc

SEQ ID NO: 759 - DNA, 20 bp, Artificial Sequence
  Description of Artificial Sequence: Synthetic probe
cctgccagaagagtctagtc

SEQ ID NO: 760 - DNA, 20 bp, Artificial Sequence
  Description of Artificial Sequence: Synthetic probe
ctgctcccacagtttggagg

SEQ ID NO: 761 - DNA, 20 bp, Artificial Sequence
  Description of Artificial Sequence: Synthetic probe
ttggtgtccgctatgatgag

SEQ ID NO: 762 - DNA, 20 bp, Artificial Sequence
  Description of Artificial Sequence: Synthetic probe
ccactggggaaaaatgatgg

SEQ ID NO: 763 - DNA, 20 bp, Artificial Sequence
  Description of Artificial Sequence: Synthetic probe
cggagtactgctaagtgtac

SEQ ID NO: 764 - DNA, 20 bp, Artificial Sequence
  Description of Artificial Sequence: Synthetic probe
ctgtgtcaaatccgcacagg

SEQ ID NO: 765 - DNA, 20 bp, Artificial Sequence
  Description of Artificial Sequence: Synthetic probe
gctgccgtccccactcaggc

SEQ ID NO: 766 - DNA, 20 bp, Artificial Sequence
  Description of Artificial Sequence: Synthetic probe
gtggtctgcagcgctgtcag

SEQ ID NO: 767 - DNA, 20 bp, Artificial Sequence
  Description of Artificial Sequence: Synthetic probe
ccctgaatttgacctacttg

SEQ ID NO: 768 - DNA, 20 bp, Artificial Sequence
  Description of Artificial Sequence: Synthetic probe
ctggggtacagttgcttcct

SEQ ID NO: 769 - DNA, 20 bp, Artificial Sequence
  Description of Artificial Sequence: Synthetic probe
ttcagaaaatacacaacagc

SEQ ID NO: 770 - DNA, 20 bp, Artificial Sequence
  Description of Artificial Sequence: Synthetic probe
cccttctgcccccgcacaga

SEQ ID NO: 771 - DNA, 20 bp, Artificial Sequence
  Description of Artificial Sequence: Synthetic probe
tttcctgcttttgagttgac

SEQ ID NO: 772 - DNA, 20 bp, Artificial Sequence
  Description of Artificial Sequence: Synthetic probe
ctgacttccttcttgaaatg

SEQ ID NO: 773 - DNA, 20 bp, Artificial Sequence
  Description of Artificial Sequence: Synthetic probe
tggcctctgtgatcctcttc

SEQ ID NO: 774 - DNA, 20 bp, Artificial Sequence
  Description of Artificial Sequence: Synthetic probe
gccaatcccatcagccccat

SEQ ID NO: 775 - DNA, 20 bp, Artificial Sequence
  Description of Artificial Sequence: Synthetic probe
tctgactttctcttctacac

SEQ ID NO: 776 - DNA, 20 bp, Artificial Sequence
  Description of Artificial Sequence: Synthetic probe
gtcctttcctgaagtgtcga

SEQ ID NO: 777 - DNA, 20 bp, Artificial Sequence
  Description of Artificial Sequence: Synthetic probe
tgaggttctgacaacagtac

SEQ ID NO: 778 - DNA, 20 bp, Artificial Sequence
  Description of Artificial Sequence: Synthetic probe
ccatcccccacagtacccct

SEQ ID NO: 779 - DNA, 20 bp, Artificial Sequence
  Description of Artificial Sequence: Synthetic probe
gctgaggggctgttcaccac

SEQ ID NO: 780 - DNA, 20 bp, Artificial Sequence
  Description of Artificial Sequence: Synthetic probe
catcctcgttctccagggtc

SEQ ID NO: 781 - DNA, 20 bp, Artificial Sequence
  Description of Artificial Sequence: Synthetic probe
gaaagggacaatttgtgcag

SEQ ID NO: 782 - DNA, 20 bp, Artificial Sequence
  Description of Artificial Sequence: Synthetic probe
ctccaggatgggaaggtgga

SEQ ID NO: 783 - DNA, 20 bp, Artificial Sequence
  Description of Artificial Sequence: Synthetic probe
gtcaccctttagtttgcttg

SEQ ID NO: 784 - DNA, 20 bp, Artificial Sequence
  Description of Artificial Sequence: Synthetic probe
aactttagtaaaccacctgc

SEQ ID NO: 785 - DNA, 20 bp, Artificial Sequence
  Description of Artificial Sequence: Synthetic probe
gcatttgtggcttgaacttg

SEQ ID NO: 786 - DNA, 20 bp, Artificial Sequence
  Description of Artificial Sequence: Synthetic probe
ccagatgcaaataccacaga

SEQ ID NO: 787 - DNA, 20 bp, Artificial Sequence
  Description of Artificial Sequence: Synthetic probe
tttctgctcccctgagattc

SEQ ID NO: 788 - DNA, 20 bp, Artificial Sequence
  Description of Artificial Sequence: Synthetic probe
gtccttcagccccatcatgt

SEQ ID NO: 789 - DNA, 20 bp, Artificial Sequence
  Description of Artificial Sequence: Synthetic probe
cccagtgacacttcagagag

SEQ ID NO: 790 - DNA, 20 bp, Artificial Sequence
  Description of Artificial Sequence: Synthetic probe
ctggtagttagtagcatgtt

SEQ ID NO: 791 - DNA, 20 bp, Artificial Sequence
  Description of Artificial Sequence: Synthetic probe
tgtacagggtgacagtaagg

SEQ ID NO: 792 - DNA, 20 bp, Artificial Sequence
  Description of Artificial Sequence: Synthetic probe
gccaagcaggagaggcgtaa

SEQ ID NO: 793 - DNA, 20 bp, Artificial Sequence
  Description of Artificial Sequence: Synthetic probe
gggcattttacaagaagtac

SEQ ID NO: 794 - DNA, 20 bp, Artificial Sequence
  Description of Artificial Sequence: Synthetic probe
gaatcttatttttcctgtcc

SEQ ID NO: 795 - DNA, 20 bp, Artificial Sequence
  Description of Artificial Sequence: Synthetic probe
ggagctgcaccgagggcaac

SEQ ID NO: 796 - DNA, 20 bp, Artificial Sequence
  Description of Artificial Sequence: Synthetic probe
caggacagctgtgtgtgcag

SEQ ID NO: 797 - DNA, 20 bp, Artificial Sequence
  Description of Artificial Sequence: Synthetic probe
actgggttcttaaccagatg

SEQ ID NO: 798 - DNA, 20 bp, Artificial Sequence
  Description of Artificial Sequence: Synthetic probe
gttgtgtatgggtagcacta

SEQ ID NO: 799 - DNA, 20 bp, Artificial Sequence
  Description of Artificial Sequence: Synthetic probe
tcaacatgctacagctgatg

SEQ ID NO: 800 - DNA, 20 bp, Artificial Sequence
  Description of Artificial Sequence: Synthetic probe
gctttccccaagtactacag

SEQ ID NO: 801 - DNA, 20 bp, Artificial Sequence
  Description of Artificial Sequence: Synthetic probe
gaagtgacatgccctggaga

SEQ ID NO: 802 - DNA, 20 bp, Artificial Sequence
  Description of Artificial Sequence: Synthetic probe
cttgtgggaagtgggttgga

SEQ ID NO: 803 - DNA, 20 bp, Artificial Sequence
  Description of Artificial Sequence: Synthetic probe
caccgagctaagtctgtgtg

SEQ ID NO: 804 - DNA, 20 bp, Artificial Sequence
  Description of Artificial Sequence: Synthetic probe
cagcattagtacccgctgcc

SEQ ID NO: 805 - DNA, 20 bp, Artificial Sequence
  Description of Artificial Sequence: Synthetic probe
cccattcctgtgtgtccgtc

SEQ ID NO: 806 - DNA, 20 bp, Artificial Sequence
  Description of Artificial Sequence: Synthetic probe
ctgccatttagccacagaag

SEQ ID NO: 807 - DNA, 20 bp, Artificial Sequence
  Description of Artificial Sequence: Synthetic probe
ccctagtctgttggtagaac

SEQ ID NO: 808 - DNA, 20 bp, Artificial Sequence
  Description of Artificial Sequence: Synthetic probe
cagaaatcaatatgttgtct

SEQ ID NO: 809 - DNA, 20 bp, Artificial Sequence
  Description of Artificial Sequence: Synthetic probe
gcatgcaccttcgtcagtac

SEQ ID NO: 810 - DNA, 20 bp, Artificial Sequence
  Description of Artificial Sequence: Synthetic probe
gagctgctctaagaagggaa

SEQ ID NO: 811 - DNA, 20 bp, Artificial Sequence
  Description of Artificial Sequence: Synthetic probe
tcggcccctcacaaatgcag

SEQ ID NO: 812 - DNA, 20 bp, Artificial Sequence
  Description of Artificial Sequence: Synthetic probe
ccaagtcatgtaattagtca

SEQ ID NO: 813 - DNA, 20 bp, Artificial Sequence
  Description of Artificial Sequence: Synthetic probe
ggaagtactcagagatcatg

SEQ ID NO: 814 - DNA, 20 bp, Artificial Sequence
  Description of Artificial Sequence: Synthetic probe
gctgaaaaagcagcaaatgc

SEQ ID NO: 815 - DNA, 20 bp, Artificial Sequence
  Description of Artificial Sequence: Synthetic probe
acagatgcccgaatgctagc

SEQ ID NO: 816 - DNA, 20 bp, Artificial Sequence
  Description of Artificial Sequence: Synthetic probe
gagccagaacattgtgatca

SEQ ID NO: 817 - DNA, 20 bp, Artificial Sequence
  Description of Artificial Sequence: Synthetic probe
agatcgagggtggatgatac

SEQ ID NO: 818 - DNA, 20 bp, Artificial Sequence
  Description of Artificial Sequence: Synthetic probe
catttcctgaccccgttttc

SEQ ID NO: 819 - DNA, 20 bp, Artificial Sequence
  Description of Artificial Sequence: Synthetic probe
gcaccggaatgccaattaac

SEQ ID NO: 820 - DNA, 20 bp, Artificial Sequence
  Description of Artificial Sequence: Synthetic probe
tagagaccctccagccccca

SEQ ID NO: 821 - DNA, 20 bp, Artificial Sequence
  Description of Artificial Sequence: Synthetic probe
cactttggggcctcattaac

SEQ ID NO: 822 - DNA, 20 bp, Artificial Sequence
  Description of Artificial Sequence: Synthetic probe
cctttagagacaagctttgc

SEQ ID NO: 823 - DNA, 20 bp, Artificial Sequence
  Description of Artificial Sequence: Synthetic probe
gggttaaaatcggcctgtgg

SEQ ID NO: 824 - DNA, 20 bp, Artificial Sequence
  Description of Artificial Sequence: Synthetic probe
ggtgtggtgagaaggcaggt

SEQ ID NO: 825 - DNA, 20 bp, Artificial Sequence
  Description of Artificial Sequence: Synthetic probe
tgcccgctgcagtttcttgg

SEQ ID NO: 826 - DNA, 20 bp, Artificial Sequence
  Description of Artificial Sequence: Synthetic probe
gacataggagcgcaaagaag

SEQ ID NO: 827 - DNA, 20 bp, Artificial Sequence
  Description of Artificial Sequence: Synthetic probe
gtctcttgtggcccaaacag

SEQ ID NO: 828 - DNA, 20 bp, Artificial Sequence
  Description of Artificial Sequence: Synthetic probe
gttaggtagactatcgcctc

SEQ ID NO: 829 - DNA, 20 bp, Artificial Sequence
  Description of Artificial Sequence: Synthetic probe
aacctctgaagacactaagc

SEQ ID NO: 830 - DNA, 20 bp, Artificial Sequence
  Description of Artificial Sequence: Synthetic probe
ctcagaccatggaacggtga

SEQ ID NO: 831 - DNA, 20 bp, Artificial Sequence
  Description of Artificial Sequence: Synthetic probe
ctgaaatcaaccctcatcac

SEQ ID NO: 832 - DNA, 20 bp, Artificial Sequence
  Description of Artificial Sequence: Synthetic probe
cgatggctccactcccatca

SEQ ID NO: 833 - DNA, 20 bp, Artificial Sequence
  Description of Artificial Sequence: Synthetic probe
ttcaaggctagagctgctgg

SEQ ID NO: 834 - DNA, 20 bp, Artificial Sequence
  Description of Artificial Sequence: Synthetic probe
ggaggggctgcctgttttac

SEQ ID NO: 835 - DNA, 20 bp, Artificial Sequence
  Description of Artificial Sequence: Synthetic probe
gtggcaggaggatgataaag

SEQ ID NO: 836 - DNA, 20 bp, Artificial Sequence
  Description of Artificial Sequence: Synthetic probe
cacgcggcccctcccaaagg

SEQ ID NO: 837 - DNA, 20 bp, Artificial Sequence
  Description of Artificial Sequence: Synthetic probe
atgcgtagatagaagaagcc

SEQ ID NO: 838 - DNA, 20 bp, Artificial Sequence
  Description of Artificial Sequence: Synthetic probe
ccacgggagccaggatggga

SEQ ID NO: 839 - DNA, 20 bp, Artificial Sequence
  Description of Artificial Sequence: Synthetic probe
atagtatactctcctgtttg

SEQ ID NO: 840 - DNA, 20 bp, Artificial Sequence
  Description of Artificial Sequence: Synthetic probe
gagacagaggaagaaccagg

SEQ ID NO: 841 - DNA, 20 bp, Artificial Sequence
  Description of Artificial Sequence: Synthetic probe
tacacccagccccgagtgtg

SEQ ID NO: 842 - DNA, 20 bp, Artificial Sequence
  Description of Artificial Sequence: Synthetic probe
catcacggtaaaagagctga

SEQ ID NO: 843 - DNA, 20 bp, Artificial Sequence
  Description of Artificial Sequence: Synthetic probe
cattgtgaccggaatcactg

SEQ ID NO: 844 - DNA, 20 bp, Artificial Sequence
  Description of Artificial Sequence: Synthetic probe
gattaatcctcacatgttag

SEQ ID NO: 845 - DNA, 20 bp, Artificial Sequence
  Description of Artificial Sequence: Synthetic probe
agctgggatagaaaggccac

SEQ ID NO: 846 - DNA, 20 bp, Artificial Sequence
  Description of Artificial Sequence: Synthetic probe
ctcttcactctctatagaat

SEQ ID NO: 847 - DNA, 20 bp, Artificial Sequence
  Description of Artificial Sequence: Synthetic probe
catccaaagcctgaagccag

SEQ ID NO: 848 - DNA, 20 bp, Artificial Sequence
  Description of Artificial Sequence: Synthetic probe
gtgggtgtgggcaggggctg

SEQ ID NO: 849 - DNA, 20 bp, Artificial Sequence
  Description of Artificial Sequence: Synthetic probe
gggcaagtagcaggactagg

SEQ ID NO: 850 - DNA, 20 bp, Artificial Sequence
  Description of Artificial Sequence: Synthetic probe
catgtcagaggaccccaggg

SEQ ID NO: 851 - DNA, 20 bp, Artificial Sequence
  Description of Artificial Sequence: Synthetic probe
gggggagagacgctgcattc

SEQ ID NO: 852 - DNA, 20 bp, Artificial Sequence
  Description of Artificial Sequence: Synthetic probe
cagaaacgtcttaacacttg

SEQ ID NO: 853 - DNA, 20 bp, Artificial Sequence
  Description of Artificial Sequence: Synthetic probe
ctggatgtttttgtccactg

SEQ ID NO: 854 - DNA, 20 bp, Artificial Sequence
  Description of Artificial Sequence: Synthetic probe
ggagaggcagcttggtggag

SEQ ID NO: 855 - DNA, 20 bp, Artificial Sequence
  Description of Artificial Sequence: Synthetic probe
gaacacacttgggagcagtc

SEQ ID NO: 856 - DNA, 20 bp, Artificial Sequence
  Description of Artificial Sequence: Synthetic probe
ctatgtctcagtgcccctta

SEQ ID NO: 857 - DNA, 20 bp, Artificial Sequence
  Description of Artificial Sequence: Synthetic probe
ccctctgtggagcgcccgcc

SEQ ID NO: 858 - DNA, 20 bp, Artificial Sequence
  Description of Artificial Sequence: Synthetic probe
gtctgctccggggtggttca

SEQ ID NO: 859 - DNA, 20 bp, Artificial Sequence
  Description of Artificial Sequence: Synthetic probe
cactcctctcgcagctgtac

SEQ ID NO: 860 - DNA, 20 bp, Artificial Sequence
  Description of Artificial Sequence: Synthetic probe
cactcgccagcgcgacggtt

SEQ ID NO: 861 - DNA, 20 bp, Artificial Sequence
  Description of Artificial Sequence: Synthetic probe
gcctggccacccacactctg

SEQ ID NO: 862 - DNA, 20 bp, Artificial Sequence
  Description of Artificial Sequence: Synthetic probe
catgccctcaccccacttct

SEQ ID NO: 863 - DNA, 20 bp, Artificial Sequence
  Description of Artificial Sequence: Synthetic probe
gatggatggtgaggaggaag

SEQ ID NO: 864 - DNA, 20 bp, Artificial Sequence
  Description of Artificial Sequence: Synthetic probe
gacttaaggacagcatgtct

SEQ ID NO: 865 - DNA, 20 bp, Artificial Sequence
  Description of Artificial Sequence: Synthetic probe
ttcatcttcagtctaccagc

SEQ ID NO: 866 - DNA, 20 bp, Artificial Sequence
  Description of Artificial Sequence: Synthetic probe
ccccgctgtgtcggatacac

SEQ ID NO: 867 - DNA, 20 bp, Artificial Sequence
  Description of Artificial Sequence: Synthetic probe
ggggatttttcagtggaacc

SEQ ID NO: 868 - DNA, 20 bp, Artificial Sequence
  Description of Artificial Sequence: Synthetic probe
cttgcccccaaatgtcgacc

SEQ ID NO: 869 - DNA, 20 bp, Artificial Sequence
  Description of Artificial Sequence: Synthetic probe
accccagagggagttgtcac

SEQ ID NO: 870 - DNA, 20 bp, Artificial Sequence
  Description of Artificial Sequence: Synthetic probe
gctacagtgagtggctggcc

SEQ ID NO: 871 - DNA, 20 bp, Artificial Sequence
  Description of Artificial Sequence: Synthetic probe
aataggaagaggtgttgagc

SEQ ID NO: 872 - DNA, 20 bp, Artificial Sequence
  Description of Artificial Sequence: Synthetic probe
ctggactgtgggaggaaaga

SEQ ID NO: 873 - DNA, 20 bp, Artificial Sequence
  Description of Artificial Sequence: Synthetic probe
gtggtcaccagggggacagg

SEQ ID NO: 874 - DNA, 20 bp, Artificial Sequence
  Description of Artificial Sequence: Synthetic probe
gagccccccaccaatgtatc

SEQ ID NO: 875 - DNA, 20 bp, Artificial Sequence
  Description of Artificial Sequence: Synthetic probe
attttctcttggggtacgtg

SEQ ID NO: 876 - DNA, 20 bp, Artificial Sequence
  Description of Artificial Sequence: Synthetic probe
cctgacagtgtttaaggtgt

SEQ ID NO: 877 - DNA, 20 bp, Artificial Sequence
  Description of Artificial Sequence: Synthetic probe
tgaaatccatgttaatgatg

SEQ ID NO: 878 - DNA, 20 bp, Artificial Sequence
  Description of Artificial Sequence: Synthetic probe
cttaagaaactcttgaaggc

SEQ ID NO: 879 - DNA, 20 bp, Artificial Sequence
  Description of Artificial Sequence: Synthetic probe
aaggcaagcagcagtatctg

SEQ ID NO: 880 - DNA, 20 bp, Artificial Sequence
  Description of Artificial Sequence: Synthetic probe
cagtccatagaagagcgtga

SEQ ID NO: 881 - DNA, 20 bp, Artificial Sequence
  Description of Artificial Sequence: Synthetic probe
tgctgtcaacttcccatctg

SEQ ID NO: 882 - DNA, 20 bp, Artificial Sequence
  Description of Artificial Sequence: Synthetic probe
gctcagcatagggtcacttt

SEQ ID NO: 883 - DNA, 20 bp, Artificial Sequence
  Description of Artificial Sequence: Synthetic probe
gttggagcctcaggaagaac

SEQ ID NO: 884 - DNA, 20 bp, Artificial Sequence
  Description of Artificial Sequence: Synthetic probe
cagcaaaagacagtccaacg

SEQ ID NO: 885 - DNA, 20 bp, Artificial Sequence
  Description of Artificial Sequence: Synthetic probe
agtggacaagaaaccaccag

SEQ ID NO: 886 - DNA, 20 bp, Artificial Sequence
  Description of Artificial Sequence: Synthetic probe
cattgagctaacccagtaca

SEQ ID NO: 887 - DNA, 20 bp, Artificial Sequence
  Description of Artificial Sequence: Synthetic probe
ggaactacatttcactcttg

SEQ ID NO: 888 - DNA, 20 bp, Artificial Sequence
  Description of Artificial Sequence: Synthetic probe
gttttcaggatataacagca

SEQ ID NO: 889 - DNA, 20 bp, Artificial Sequence
  Description of Artificial Sequence: Synthetic probe
tcaaacttgtgaggtgtttg

SEQ ID NO: 890 - DNA, 20 bp, Artificial Sequence
  Description of Artificial Sequence: Synthetic probe
catgtggccattaccgtcat

SEQ ID NO: 891 - DNA, 20 bp, Artificial Sequence
  Description of Artificial Sequence: Synthetic probe
gtccttattatcccagcttg

SEQ ID NO: 892 - DNA, 20 bp, Artificial Sequence
  Description of Artificial Sequence: Synthetic probe
ctgaggggcagggagagcgc

SEQ ID NO: 893 - DNA, 20 bp, Artificial Sequence
  Description of Artificial Sequence: Synthetic probe
ctttgtgggggcagcaggag

SEQ ID NO: 894 - DNA, 20 bp, Artificial Sequence
  Description of Artificial Sequence: Synthetic probe
cctctcagctttttcgtatt

SEQ ID NO: 895 - DNA, 20 bp, Artificial Sequence
  Description of Artificial Sequence: Synthetic probe
tggccgagagcctcaactac

SEQ ID NO: 896 - DNA, 20 bp, Artificial Sequence
  Description of Artificial Sequence: Synthetic probe
gtggcgtcctggaacatgag

SEQ ID NO: 897 - DNA, 20 bp, Artificial Sequence
  Description of Artificial Sequence: Synthetic probe
accacctctgtctgattcac

SEQ ID NO: 898 - DNA, 20 bp, Artificial Sequence
  Description of Artificial Sequence: Synthetic probe
cttcgctggattctaaatgt

SEQ ID NO: 899 - DNA, 20 bp, Artificial Sequence
  Description of Artificial Sequence: Synthetic probe
aactctgttgggtgaactgg

SEQ ID NO: 900 - DNA, 20 bp, Artificial Sequence
  Description of Artificial Sequence: Synthetic probe
tattgctgctggagggctgt

SEQ ID NO: 901 - DNA, 20 bp, Artificial Sequence
  Description of Artificial Sequence: Synthetic probe
ggtcatttggcacttctcag

SEQ ID NO: 902 - DNA, 20 bp, Artificial Sequence
  Description of Artificial Sequence: Synthetic probe
caagtaggatacttctcatg

SEQ ID NO: 903 - DNA, 20 bp, Artificial Sequence
  Description of Artificial Sequence: Synthetic probe
aggacctgggccattgcaac

SEQ ID NO: 904 - DNA, 20 bp, Artificial Sequence
  Description of Artificial Sequence: Synthetic probe
caaaatggggacttcctggg

SEQ ID NO: 905 - DNA, 20 bp, Artificial Sequence
  Description of Artificial Sequence: Synthetic probe
ccccgccagccgcgatacgg

SEQ ID NO: 906 - DNA, 20 bp, Artificial Sequence
  Description of Artificial Sequence: Synthetic probe
cgcagttcctatattcatgt

SEQ ID NO: 907 - DNA, 20 bp, Artificial Sequence
  Description of Artificial Sequence: Synthetic probe
tccagagtgaagatgggtga

SEQ ID NO: 908 - DNA, 20 bp, Artificial Sequence
  Description of Artificial Sequence: Synthetic probe
ctagatgatatgtgtgggtg

SEQ ID NO: 909 - DNA, 20 bp, Artificial Sequence
  Description of Artificial Sequence: Synthetic probe
cttcagggacttgtgtactg

SEQ ID NO: 910 - DNA, 20 bp, Artificial Sequence
  Description of Artificial Sequence: Synthetic probe
gttatgggggtgccagaggc

SEQ ID NO: 911 - DNA, 20 bp, Artificial Sequence
  Description of Artificial Sequence: Synthetic probe
tcagtatgtctcctgcacag

SEQ ID NO: 912 - DNA, 20 bp, Artificial Sequence
  Description of Artificial Sequence: Synthetic probe
ctgggaaccacgatctacaa

SEQ ID NO: 913 - DNA, 20 bp, Artificial Sequence
  Description of Artificial Sequence: Synthetic probe
acccattcacttagcgtttg

SEQ ID NO: 914 - DNA, 20 bp, Artificial Sequence
  Description of Artificial Sequence: Synthetic probe
ctccagtagctttccctctg

SEQ ID NO: 915 - DNA, 20 bp, Artificial Sequence
  Description of Artificial Sequence: Synthetic probe
gaaggggaagatctgagagc

SEQ ID NO: 916 - DNA, 20 bp, Artificial Sequence
  Description of Artificial Sequence: Synthetic probe
gtgctgtttgtggctgttga

SEQ ID NO: 917 - DNA, 20 bp, Artificial Sequence
  Description of Artificial Sequence: Synthetic probe
ggcccaccccaattttgtaa

SEQ ID NO: 918 - DNA, 20 bp, Artificial Sequence
  Description of Artificial Sequence: Synthetic probe
catgatgcaagtgtctggca

SEQ ID NO: 919 - DNA, 20 bp, Artificial Sequence
  Description of Artificial Sequence: Synthetic probe
gcttactatccaaatctgtc

SEQ ID NO: 920 - DNA, 20 bp, Artificial Sequence
  Description of Artificial Sequence: Synthetic probe
cttggaagacatgctcaaca

SEQ ID NO: 921 - DNA, 20 bp, Artificial Sequence
  Description of Artificial Sequence: Synthetic probe
ctggggctgtggtcaccctc

SEQ ID NO: 922 - DNA, 20 bp, Artificial Sequence
  Description of Artificial Sequence: Synthetic probe
gaatgcgtggagaagctgat

SEQ ID NO: 923 - DNA, 20 bp, Artificial Sequence
  Description of Artificial Sequence: Synthetic probe
ttaatacagcagtgtcatca

SEQ ID NO: 924 - DNA, 20 bp, Artificial Sequence
  Description of Artificial Sequence: Synthetic probe
gaagataacttgagcaccgt

SEQ ID NO: 925 - DNA, 20 bp, Artificial Sequence
  Description of Artificial Sequence: Synthetic probe
ttatccccactgctgtggag

SEQ ID NO: 926 - DNA, 20 bp, Artificial Sequence
  Description of Artificial Sequence: Synthetic probe
gtttctgtacctcgcttgga

SEQ ID NO: 927 - DNA, 20 bp, Artificial Sequence
  Description of Artificial Sequence: Synthetic probe
gccttgtggtgttggatcag

SEQ ID NO: 928 - DNA, 20 bp, Artificial Sequence
  Description of Artificial Sequence: Synthetic probe
gtactgtgtctgctcataag

SEQ ID NO: 929 - DNA, 20 bp, Artificial Sequence
  Description of Artificial Sequence: Synthetic probe
aaaccagtgcttcagattcg

SEQ ID NO: 930 - DNA, 20 bp, Artificial Sequence
  Description of Artificial Sequence: Synthetic probe
cagaactcagtgaaggaagc

SEQ ID NO: 931 - DNA, 20 bp, Artificial Sequence
  Description of Artificial Sequence: Synthetic probe
ttctttgcctcaagacactg

SEQ ID NO: 932 - DNA, 20 bp, Artificial Sequence
  Description of Artificial Sequence: Synthetic probe
gcacattcattagcaagatt

SEQ ID NO: 933 - DNA, 20 bp, Artificial Sequence
  Description of Artificial Sequence: Synthetic probe
catgatgctggggagcttgg

SEQ ID NO: 934 - DNA, 20 bp, Artificial Sequence
  Description of Artificial Sequence: Synthetic probe
cgcctgacccaggatctaga

SEQ ID NO: 935 - DNA, 20 bp, Artificial Sequence
  Description of Artificial Sequence: Synthetic probe
tagtagaaaacccgacattg

SEQ ID NO: 936 - DNA, 20 bp, Artificial Sequence
  Description of Artificial Sequence: Synthetic probe
atgtttcttcctgttgcaag

SEQ ID NO: 937 - DNA, 20 bp, Artificial Sequence
  Description of Artificial Sequence: Synthetic probe
atctatagttgccagccctg

SEQ ID NO: 938 - DNA, 20 bp, Artificial Sequence
  Description of Artificial Sequence: Synthetic probe
gtcagttttgattcttaacc

SEQ ID NO: 939 - DNA, 20 bp, Artificial Sequence
  Description of Artificial Sequence: Synthetic probe
ccttcaggccagaagcaaac

SEQ ID NO: 940 - DNA, 20 bp, Artificial Sequence
  Description of Artificial Sequence: Synthetic probe
caaatttaccaggtttggct

SEQ ID NO: 941 - DNA, 20 bp, Artificial Sequence
  Description of Artificial Sequence: Synthetic probe
gatggcaagggctttttcag

SEQ ID NO: 942 - DNA, 20 bp, Artificial Sequence
  Description of Artificial Sequence: Synthetic probe
catctcgtttatgtgtggaa

SEQ ID NO: 943 - DNA, 20 bp, Artificial Sequence
  Description of Artificial Sequence: Synthetic probe
actgctgagtggagacagag

SEQ ID NO: 944 - DNA, 20 bp, Artificial Sequence
  Description of Artificial Sequence: Synthetic probe
ctgcggggtcccatctggac

SEQ ID NO: 945 - DNA, 20 bp, Artificial Sequence
  Description of Artificial Sequence: Synthetic probe
tgatgtgggcagagatgagg

SEQ ID NO: 946 - DNA, 20 bp, Artificial Sequence
  Description of Artificial Sequence: Synthetic probe
ccaagaacggagaagggagg

SEQ ID NO: 947 - DNA, 20 bp, Artificial Sequence
  Description of Artificial Sequence: Synthetic probe
ggtggaacccagaaacggac

SEQ ID NO: 948 - DNA, 20 bp, Artificial Sequence
  Description of Artificial Sequence: Synthetic probe
gccggtgcttggaggggttc

SEQ ID NO: 949 - DNA, 20 bp, Artificial Sequence
  Description of Artificial Sequence: Synthetic probe
cgctgcagggagcaccacgg

SEQ ID NO: 950 - DNA, 20 bp, Artificial Sequence
  Description of Artificial Sequence: Synthetic probe
ccagaagtaacttattttgt

SEQ ID NO: 951 - DNA, 20 bp, Artificial Sequence
  Description of Artificial Sequence: Synthetic probe
agagcctcccggccttctcc

SEQ ID NO: 952 - DNA, 20 bp, Artificial Sequence
  Description of Artificial Sequence: Synthetic probe
ggtgtcctgtaccaactctt

SEQ ID NO: 953 - DNA, 20 bp, Artificial Sequence
  Description of Artificial Sequence: Synthetic probe
ttgcccaagtgtgagattac

SEQ ID NO: 954 - DNA, 20 bp, Artificial Sequence
  Description of Artificial Sequence: Synthetic probe
ctttctgttccttgcagttc

SEQ ID NO: 955 - DNA, 20 bp, Artificial Sequence
  Description of Artificial Sequence: Synthetic probe
agtttccaagggttttcaag

SEQ ID NO: 956 - DNA, 20 bp, Artificial Sequence
  Description of Artificial Sequence: Synthetic probe
cctacttacctttataaagg

SEQ ID NO: 957 - DNA, 20 bp, Artificial Sequence
  Description of Artificial Sequence: Synthetic probe
ctctccctccgtacacttcg

SEQ ID NO: 958 - DNA, 20 bp, Artificial Sequence
  Description of Artificial Sequence: Synthetic probe
cgcaccttctcaccttttgt

SEQ ID NO: 959 - DNA, 20 bp, Artificial Sequence
  Description of Artificial Sequence: Synthetic probe
tcaaagatgataatttagtg

SEQ ID NO: 960 - DNA, 20 bp, Artificial Sequence
  Description of Artificial Sequence: Synthetic probe
gattaaccagtccagacgca

SEQ ID NO: 961 - DNA, 20 bp, Artificial Sequence
  Description of Artificial Sequence: Synthetic probe
ttcttcaagaccataaactg

SEQ ID NO: 962 - DNA, 20 bp, Artificial Sequence
  Description of Artificial Sequence: Synthetic probe
gactctgctggaaaagcgga

SEQ ID NO: 963 - DNA, 20 bp, Artificial Sequence
  Description of Artificial Sequence: Synthetic probe
gggcctgttagtcttcgaag

SEQ ID NO: 964 - DNA, 20 bp, Artificial Sequence
  Description of Artificial Sequence: Synthetic probe
cttccagatggtttgtgttt

SEQ ID NO: 965 - DNA, 20 bp, Artificial Sequence
  Description of Artificial Sequence: Synthetic probe
ggggtttcttcatattcctg

SEQ ID NO: 966 - DNA, 20 bp, Artificial Sequence
  Description of Artificial Sequence: Synthetic probe
ctgttggaagcagttgacca

SEQ ID NO: 967 - DNA, 20 bp, Artificial Sequence
  Description of Artificial Sequence: Synthetic probe
ggcaggacggcaggggtgag

SEQ ID NO: 968 - DNA, 20 bp, Artificial Sequence
  Description of Artificial Sequence: Synthetic probe
cagctttgggagagacacct

SEQ ID NO: 969 - DNA, 20 bp, Artificial Sequence
  Description of Artificial Sequence: Synthetic probe
tgaccttttctggaatccac

SEQ ID NO: 970 - DNA, 20 bp, Artificial Sequence
  Description of Artificial Sequence: Synthetic probe
ctgttgagatgctttatagc

SEQ ID NO: 971 - DNA, 20 bp, Artificial Sequence
  Description of Artificial Sequence: Synthetic probe
agctctgccttccggaatcc

SEQ ID NO: 972 - DNA, 20 bp, Artificial Sequence
  Description of Artificial Sequence: Synthetic probe
ctctaagtctgcttgataga

SEQ ID NO: 973 - DNA, 20 bp, Artificial Sequence
  Description of Artificial Sequence: Synthetic probe
cccaggctgcccagcctgtc

SEQ ID NO: 974 - DNA, 20 bp, Artificial Sequence
  Description of Artificial Sequence: Synthetic probe
cttgtgtcgtctttttaatt

SEQ ID NO: 975 - DNA, 20 bp, Artificial Sequence
  Description of Artificial Sequence: Synthetic probe
atctgtgtgtgccctgtaac

SEQ ID NO: 976 - DNA, 20 bp, Artificial Sequence
  Description of Artificial Sequence: Synthetic probe
ctgactggttaacagcagtc

SEQ ID NO: 977 - DNA, 20 bp, Artificial Sequence
  Description of Artificial Sequence: Synthetic probe
gggacagacctttgaccgtc

SEQ ID NO: 978 - DNA, 20 bp, Artificial Sequence
  Description of Artificial Sequence: Synthetic probe
gctcacgggtcttaccccat

SEQ ID NO: 979 - DNA, 20 bp, Artificial Sequence
  Description of Artificial Sequence: Synthetic probe
ctgtggatggtgccattcag

SEQ ID NO: 980 - DNA, 20 bp, Artificial Sequence
  Description of Artificial Sequence: Synthetic probe
caagtagttagttcaggggg

SEQ ID NO: 981 - DNA, 20 bp, Artificial Sequence
  Description of Artificial Sequence: Synthetic probe
gacacaaggaggcagaggag

SEQ ID NO: 982 - DNA, 20 bp, Artificial Sequence
  Description of Artificial Sequence: Synthetic probe
ctaacccctctactccactt

SEQ ID NO: 983 - DNA, 20 bp, Artificial Sequence
  Description of Artificial Sequence: Synthetic probe
agacctaatgctccttgttc

SEQ ID NO: 984 - DNA, 20 bp, Artificial Sequence
  Description of Artificial Sequence: Synthetic probe
ctagagtagagtggagggag

SEQ ID NO: 985 - DNA, 20 bp, Artificial Sequence
  Description of Artificial Sequence: Synthetic probe
tgccttcattgagtttaaag

SEQ ID NO: 986 - DNA, 20 bp, Artificial Sequence
  Description of Artificial Sequence: Synthetic probe
ggacaggattgcccttccgt

SEQ ID NO: 987 - DNA, 20 bp, Artificial Sequence
  Description of Artificial Sequence: Synthetic probe
cgcctactgcctctctcgtg

SEQ ID NO: 988 - DNA, 20 bp, Artificial Sequence
  Description of Artificial Sequence: Synthetic probe
ccataacaaataaccagtat

SEQ ID NO: 989 - DNA, 20 bp, Artificial Sequence
  Description of Artificial Sequence: Synthetic probe
gcatgtctgctgggtgtgac

SEQ ID NO: 990 - DNA, 20 bp, Artificial Sequence
  Description of Artificial Sequence: Synthetic probe
catgtttcctctcaataaag

SEQ ID NO: 991 - DNA, 20 bp, Artificial Sequence
  Description of Artificial Sequence: Synthetic probe
atgatttggcgattcgagtg

SEQ ID NO: 992 - DNA, 20 bp, Artificial Sequence
  Description of Artificial Sequence: Synthetic probe
gctgcagtacaggatctgac

SEQ ID NO: 993 - DNA, 20 bp, Artificial Sequence
  Description of Artificial Sequence: Synthetic probe
gcgcccccgttaccttgaac

SEQ ID NO: 994 - DNA, 20 bp, Artificial Sequence
  Description of Artificial Sequence: Synthetic probe
ttgagggacctgttctccac

SEQ ID NO: 995 - DNA, 20 bp, Artificial Sequence
  Description of Artificial Sequence: Synthetic probe
gacaagctaaccaggtttac

SEQ ID NO: 996 - DNA, 20 bp, Artificial Sequence
  Description of Artificial Sequence: Synthetic probe
catctcactcccagtaatac

SEQ ID NO: 997 - DNA, 20 bp, Artificial Sequence
  Description of Artificial Sequence: Synthetic probe
aatcaccaatcaaggcctcc

SEQ ID NO: 998 - DNA, 20 bp, Artificial Sequence
  Description of Artificial Sequence: Synthetic probe
gttcttctaaagattagtcc

SEQ ID NO: 999 - DNA, 20 bp, Artificial Sequence
  Description of Artificial Sequence: Synthetic probe
caattcctgactgctcacag

SEQ ID NO: 1000 - DNA, 20 bp, Artificial Sequence
  Description of Artificial Sequence: Synthetic probe
gttgcccctgactctggctg

SEQ ID NO: 1001 - DNA, 20 bp, Artificial Sequence
  Description of Artificial Sequence: Synthetic probe
gtctcaggcctccaactttg

SEQ ID NO: 1002 - DNA, 20 bp, Artificial Sequence
  Description of Artificial Sequence: Synthetic probe
gccttcaggacaccctgtaa

SEQ ID NO: 1003 - DNA, 20 bp, Artificial Sequence
  Description of Artificial Sequence: Synthetic probe
cagttttctgctgaaggcac

SEQ ID NO: 1004 - DNA, 20 bp, Artificial Sequence
  Description of Artificial Sequence: Synthetic probe
ctactcagtatcttttcctc

SEQ ID NO: 1005 - DNA, 20 bp, Artificial Sequence
  Description of Artificial Sequence: Synthetic probe
tttcattaagtttttccctc

SEQ ID NO: 1006 - DNA, 20 bp, Artificial Sequence
  Description of Artificial Sequence: Synthetic probe
caaggtagaatttgcaagag

SEQ ID NO: 1007 - DNA, 20 bp, Artificial Sequence
  Description of Artificial Sequence: Synthetic probe
gatgtctagcacccccatcc

SEQ ID NO: 1008 - DNA, 20 bp, Artificial Sequence
  Description of Artificial Sequence: Synthetic probe
ccttggcccttcctcatgct

SEQ ID NO: 1009 - DNA, 20 bp, Artificial Sequence
  Description of Artificial Sequence: Synthetic probe
gggtatgcagaatgttgttg

SEQ ID NO: 1010 - DNA, 20 bp, Artificial Sequence
  Description of Artificial Sequence: Synthetic probe
gttactgttgctccccgagc

SEQ ID NO: 1011 - DNA, 20 bp, Artificial Sequence
  Description of Artificial Sequence: Synthetic probe
gccagggccaaatagctatg

SEQ ID NO: 1012 - DNA, 20 bp, Artificial Sequence
  Description of Artificial Sequence: Synthetic probe
cagagcagagatgccttcac

SEQ ID NO: 1013 - DNA, 20 bp, Artificial Sequence
  Description of Artificial Sequence: Synthetic probe
ggggggaggggatctaaatc

SEQ ID NO: 1014 - DNA, 20 bp, Artificial Sequence
  Description of Artificial Sequence: Synthetic probe
ctcatttatctcttctatgt

SEQ ID NO: 1015 - DNA, 20 bp, Artificial Sequence
  Description of Artificial Sequence: Synthetic probe
gtgttcttgcatcttgtctg

SEQ ID NO: 1016 - DNA, 20 bp, Artificial Sequence
  Description of Artificial Sequence: Synthetic probe
caaacaggtccctgcctttt

SEQ ID NO: 1017 - DNA, 20 bp, Artificial Sequence
  Description of Artificial Sequence: Synthetic probe
ctgatcacatgacaatgaag

SEQ ID NO: 1018 - DNA, 20 bp, Artificial Sequence
  Description of Artificial Sequence: Synthetic probe
cagatatggctctcccgctg

SEQ ID NO: 1019 - DNA, 20 bp, Artificial Sequence
  Description of Artificial Sequence: Synthetic probe
ctgtggacgacccgatgagc

SEQ ID NO: 1020 - DNA, 20 bp, Artificial Sequence
  Description of Artificial Sequence: Synthetic probe
ctgctatacaacatgaacga

SEQ ID NO: 1021 - DNA, 20 bp, Artificial Sequence
  Description of Artificial Sequence: Synthetic probe
aggacctcgatgtccagctg

SEQ ID NO: 1022 - DNA, 20 bp, Artificial Sequence
  Description of Artificial Sequence: Synthetic probe
ctgtcaggtctgatagtcct

SEQ ID NO: 1023 - DNA, 20 bp, Artificial Sequence
  Description of Artificial Sequence: Synthetic probe
aaggccgagaggaacactac

SEQ ID NO: 1024 - DNA, 20 bp, Artificial Sequence
  Description of Artificial Sequence: Synthetic probe
gaggaggaagaagaggagga

SEQ ID NO: 1025 - DNA, 20 bp, Artificial Sequence
  Description of Artificial Sequence: Synthetic probe
gtatcagcttgctctctttg

SEQ ID NO: 1026 - DNA, 20 bp, Artificial Sequence
  Description of Artificial Sequence: Synthetic probe
cactttcggggaaggaggac

SEQ ID NO: 1027 - DNA, 20 bp, Artificial Sequence
  Description of Artificial Sequence: Synthetic probe
agagtgaggtgtccagcctg

SEQ ID NO: 1028 - DNA, 20 bp, Artificial Sequence
  Description of Artificial Sequence: Synthetic probe
caaagctattccagctcctt

SEQ ID NO: 1029 - DNA, 20 bp, Artificial Sequence
  Description of Artificial Sequence: Synthetic probe
ctaattacctgagcgaccag

SEQ ID NO: 1030 - DNA, 20 bp, Artificial Sequence
  Description of Artificial Sequence: Synthetic probe
gactacatttcccaagaggc

SEQ ID NO: 1031 - DNA, 20 bp, Artificial Sequence
  Description of Artificial Sequence: Synthetic probe
agatcatctttgagtagcac

SEQ ID NO: 1032 - DNA, 20 bp, Artificial Sequence
  Description of Artificial Sequence: Synthetic probe
tgttttggggccctcggtct

SEQ ID NO: 1033 - DNA, 20 bp, Artificial Sequence
  Description of Artificial Sequence: Synthetic probe
gagagtacatgtattatata

SEQ ID NO: 1034 - DNA, 20 bp, Artificial Sequence
  Description of Artificial Sequence: Synthetic probe
caagcacaacagggcttgca

SEQ ID NO: 1035 - DNA, 20 bp, Artificial Sequence
  Description of Artificial Sequence: Synthetic probe
tttttcagcctgtggcccag

SEQ ID NO: 1036 - DNA, 20 bp, Artificial Sequence
  Description of Artificial Sequence: Synthetic probe
cactggtcaagaaaacaaga

SEQ ID NO: 1037 - DNA, 20 bp, Artificial Sequence
  Description of Artificial Sequence: Synthetic probe
gatgtcctgtaaacactcag

SEQ ID NO: 1038 - DNA, 20 bp, Artificial Sequence
  Description of Artificial Sequence: Synthetic probe
ctgttcagattggacataac

SEQ ID NO: 1039 - DNA, 20 bp, Artificial Sequence
  Description of Artificial Sequence: Synthetic probe
gctctcaatgggaagatgtg

SEQ ID NO: 1040 - DNA, 20 bp, Artificial Sequence
  Description of Artificial Sequence: Synthetic probe
caacacaaattaaggggaac

SEQ ID NO: 1041 - DNA, 20 bp, Artificial Sequence
  Description of Artificial Sequence: Synthetic probe
cttgttgcactgttcccagg

SEQ ID NO: 1042 - DNA, 20 bp, Artificial Sequence
  Description of Artificial Sequence: Synthetic probe
cgagtggctgccatgagacc

SEQ ID NO: 1043 - DNA, 20 bp, Artificial Sequence
  Description of Artificial Sequence: Synthetic probe
actggctgctgaaaagaaac

SEQ ID NO: 1044 - DNA, 20 bp, Artificial Sequence
  Description of Artificial Sequence: Synthetic probe
gcatcctgcactgcctgggg

SEQ ID NO: 1045 - DNA, 20 bp, Artificial Sequence
  Description of Artificial Sequence: Synthetic probe
caaagaccaaatctgaactg

SEQ ID NO: 1046 - DNA, 20 bp, Artificial Sequence
  Description of Artificial Sequence: Synthetic probe
ctaatgtggctgctttgtag

SEQ ID NO: 1047 - DNA, 20 bp, Artificial Sequence
  Description of Artificial Sequence: Synthetic probe
ccacagcatacatcctgtcc

SEQ ID NO: 1048 - DNA, 20 bp, Artificial Sequence
  Description of Artificial Sequence: Synthetic probe
gtccaagcagaggagcaaaa

SEQ ID NO: 1049 - DNA, 20 bp, Artificial Sequence
  Description of Artificial Sequence: Synthetic probe
gctcatcgtgtatgtcatgg

SEQ ID NO: 1050 - DNA, 20 bp, Artificial Sequence
  Description of Artificial Sequence: Synthetic probe
gcggtgtggccatgtcagag

SEQ ID NO: 1051 - DNA, 20 bp, Artificial Sequence
  Description of Artificial Sequence: Synthetic probe
gaggtggatgtccttctctg

SEQ ID NO: 1052 - DNA, 20 bp, Artificial Sequence
  Description of Artificial Sequence: Synthetic probe
ccaggcttggcacatgatgt

SEQ ID NO: 1053 - DNA, 20 bp, Artificial Sequence
  Description of Artificial Sequence: Synthetic probe
tacatgccaacctgggcctg

SEQ ID NO: 1054 - DNA, 20 bp, Artificial Sequence
  Description of Artificial Sequence: Synthetic probe
gtggataaccaacaagatgg

SEQ ID NO: 1055 - DNA, 20 bp, Artificial Sequence
  Description of Artificial Sequence: Synthetic probe
ctttcccaaaccagtctctg

SEQ ID NO: 1056 - DNA, 20 bp, Artificial Sequence
  Description of Artificial Sequence: Synthetic probe
cagaagccccagagaatcta

SEQ ID NO: 1057 - DNA, 20 bp, Artificial Sequence
  Description of Artificial Sequence: Synthetic probe
gcttcttcctcctccatcac

SEQ ID NO: 1058 - DNA, 20 bp, Artificial Sequence
  Description of Artificial Sequence: Synthetic probe
ctgaaacactggacctgggg

SEQ ID NO: 1059 - DNA, 20 bp, Artificial Sequence
  Description of Artificial Sequence: Synthetic probe
ggcacgggaagctggaattc

SEQ ID NO: 1060 - DNA, 20 bp, Artificial Sequence
  Description of Artificial Sequence: Synthetic probe
gtatgacggagtcttatctg

SEQ ID NO: 1061 - DNA, 20 bp, Artificial Sequence
  Description of Artificial Sequence: Synthetic probe
tttcaataatcagtttactg

SEQ ID NO: 1062 - DNA, 20 bp, Artificial Sequence
  Description of Artificial Sequence: Synthetic probe
ctctttcagggatttctaag

SEQ ID NO: 1063 - DNA, 20 bp, Artificial Sequence
  Description of Artificial Sequence: Synthetic probe
cccattctcatgtttacagg

SEQ ID NO: 1064 - DNA, 20 bp, Artificial Sequence
  Description of Artificial Sequence: Synthetic probe
ggttgtgggggcagaggggg

SEQ ID NO: 1065 - DNA, 20 bp, Artificial Sequence
  Description of Artificial Sequence: Synthetic probe
catgtttgggatggtggctc

SEQ ID NO: 1066 - DNA, 20 bp, Artificial Sequence
  Description of Artificial Sequence: Synthetic probe
ctgttgtcttgcgctctggg

SEQ ID NO: 1067 - DNA, 20 bp, Artificial Sequence
  Description of Artificial Sequence: Synthetic probe
ctgccacccagaagactgtg

SEQ ID NO: 1068 - DNA, 20 bp, Artificial Sequence
  Description of Artificial Sequence: Synthetic probe
gatggcccctccgggaaact

SEQ ID NO: 1069 - DNA, 20 bp, Artificial Sequence
  Description of Artificial Sequence: Synthetic probe
tagcctctgagactcataag

SEQ ID NO: 1070 - DNA, 20 bp, Artificial Sequence
  Description of Artificial Sequence: Synthetic probe
gccatccaggccctcaatgg

SEQ ID NO: 1071 - DNA, 20 bp, Artificial Sequence
  Description of Artificial Sequence: Synthetic probe
gcaatagaatgtatggtcac

SEQ ID NO: 1072 - DNA, 20 bp, Artificial Sequence
  Description of Artificial Sequence: Synthetic probe
ctgggtgtggccagtgcccg

SEQ ID NO: 1073 - DNA, 20 bp, Artificial Sequence
  Description of Artificial Sequence: Synthetic probe
gcagcagagactgaggggtg

SEQ ID NO: 1074 - DNA, 20 bp, Artificial Sequence
  Description of Artificial Sequence: Synthetic probe
cagagtgtgagctgggaaag

SEQ ID NO: 1075 - DNA, 20 bp, Artificial Sequence
  Description of Artificial Sequence: Synthetic probe
atcccctgtgaatcagagtg

SEQ ID NO: 1076 - DNA, 20 bp, Artificial Sequence
  Description of Artificial Sequence: Synthetic probe
cacaagcacctctcctgtga

SEQ ID NO: 1077 - DNA, 20 bp, Artificial Sequence
  Description of Artificial Sequence: Synthetic probe
accaacaacgtggtgagatg

SEQ ID NO: 1078 - DNA, 20 bp, Artificial Sequence
  Description of Artificial Sequence: Synthetic probe
caacattcactacacaggtc

SEQ ID NO: 1079 - DNA, 20 bp, Artificial Sequence
  Description of Artificial Sequence: Synthetic probe
acatccttggcggggttatg

SEQ ID NO: 1080 - DNA, 20 bp, Artificial Sequence
  Description of Artificial Sequence: Synthetic probe
gacctcttgcatgtcatagc

SEQ ID NO: 1081 - DNA, 20 bp, Artificial Sequence
  Description of Artificial Sequence: Synthetic probe
ttggccagtcatcctgaagc

SEQ ID NO: 1082 - DNA, 20 bp, Artificial Sequence
  Description of Artificial Sequence: Synthetic probe
caaagaagttgccaaagcct

SEQ ID NO: 1083 - DNA, 20 bp, Artificial Sequence
  Description of Artificial Sequence: Synthetic probe
tcaccactgccagcctcagg

SEQ ID NO: 1084 - DNA, 20 bp, Artificial Sequence
  Description of Artificial Sequence: Synthetic probe
caacatagagagcctcctgt

SEQ ID NO: 1085 - DNA, 20 bp, Artificial Sequence
  Description of Artificial Sequence: Synthetic probe
gacttaattggcatggggtg

SEQ ID NO: 1086 - DNA, 20 bp, Artificial Sequence
  Description of Artificial Sequence: Synthetic probe
cagtccaggcatcatgattt

SEQ ID NO: 1087 - DNA, 20 bp, Artificial Sequence
  Description of Artificial Sequence: Synthetic probe
acctcttaatggctcagtcc

SEQ ID NO: 1088 - DNA, 20 bp, Artificial Sequence
  Description of Artificial Sequence: Synthetic probe
ccttcaccccatttccaagt

SEQ ID NO: 1089 - DNA, 20 bp, Artificial Sequence
  Description of Artificial Sequence: Synthetic probe
tcccctaaggaaatccgagc

SEQ ID NO: 1090 - DNA, 20 bp, Artificial Sequence
  Description of Artificial Sequence: Synthetic probe
ggctacaaagcgtttcttta

SEQ ID NO: 1091 - DNA, 20 bp, Artificial Sequence
  Description of Artificial Sequence: Synthetic probe
ctgccttgtgaaatgattcc

SEQ ID NO: 1092 - DNA, 20 bp, Artificial Sequence
  Description of Artificial Sequence: Synthetic probe
ctgcagtaaacggacttttc

SEQ ID NO: 1093 - DNA, 20 bp, Artificial Sequence
  Description of Artificial Sequence: Synthetic probe
cctgcagcaaacaagagatg

SEQ ID NO: 1094 - DNA, 20 bp, Artificial Sequence
  Description of Artificial Sequence: Synthetic probe
gcaatgttttccttgttccc

SEQ ID NO: 1095 - DNA, 20 bp, Artificial Sequence
  Description of Artificial Sequence: Synthetic probe
attgatttctcaggactttg

SEQ ID NO: 1096 - DNA, 20 bp, Artificial Sequence
  Description of Artificial Sequence: Synthetic probe
gagggctctgacaccatgct

SEQ ID NO: 1097 - DNA, 20 bp, Artificial Sequence
  Description of Artificial Sequence: Synthetic probe
gccctgtgcttaagacactc

SEQ ID NO: 1098 - DNA, 20 bp, Artificial Sequence
  Description of Artificial Sequence: Synthetic probe
ctgctgccccgtctgagggt

SEQ ID NO: 1099 - DNA, 20 bp, Artificial Sequence
  Description of Artificial Sequence: Synthetic probe
cctcggatgaggagaatgag

SEQ ID NO: 1100 - DNA, 20 bp, Artificial Sequence
  Description of Artificial Sequence: Synthetic probe
gacggagacttcacggtgta

SEQ ID NO: 1101 - DNA, 20 bp, Artificial Sequence
  Description of Artificial Sequence: Synthetic probe
gacgctgagctgctcctggc

SEQ ID NO: 1102 - DNA, 20 bp, Artificial Sequence
  Description of Artificial Sequence: Synthetic probe
cgcatgcaccagcgacttcg

SEQ ID NO: 1103 - DNA, 20 bp, Artificial Sequence
  Description of Artificial Sequence: Synthetic probe
aacatctgcgcataaaggac

SEQ ID NO: 1104 - DNA, 20 bp, Artificial Sequence
  Description of Artificial Sequence: Synthetic probe
cagatgaaactctgaggatt

SEQ ID NO: 1105 - DNA, 20 bp, Artificial Sequence
  Description of Artificial Sequence: Synthetic probe
agagcctcacacctcactag

SEQ ID NO: 1106 - DNA, 20 bp, Artificial Sequence
  Description of Artificial Sequence: Synthetic probe
gtgcagagagcccaggcctt

SEQ ID NO: 1107 - DNA, 20 bp, Artificial Sequence
  Description of Artificial Sequence: Synthetic probe
tccaggaccttcttcacaag

SEQ ID NO: 1108 - DNA, 20 bp, Artificial Sequence
  Description of Artificial Sequence: Synthetic probe
atgacttgctcgctgttacc

SEQ ID NO: 1109 - DNA, 20 bp, Artificial Sequence
  Description of Artificial Sequence: Synthetic probe
ctggcgagcccttagccttg

SEQ ID NO: 1110 - DNA, 20 bp, Artificial Sequence
  Description of Artificial Sequence: Synthetic probe
ctgtagagacttccgtcacc

SEQ ID NO: 1111 - DNA, 20 bp, Artificial Sequence
  Description of Artificial Sequence: Synthetic probe
aaagctgtgtctgagatctg

SEQ ID NO: 1112 - DNA, 20 bp, Artificial Sequence
  Description of Artificial Sequence: Synthetic probe
gatctgcccatcactttggc

SEQ ID NO: 1113 - DNA, 20 bp, Artificial Sequence
  Description of Artificial Sequence: Synthetic probe
ccccttgtccctggagtagg

SEQ ID NO: 1114 - DNA, 20 bp, Artificial Sequence
  Description of Artificial Sequence: Synthetic probe
gactaactatagcacaaagt

SEQ ID NO: 1115 - DNA, 20 bp, Artificial Sequence
  Description of Artificial Sequence: Synthetic probe
ggccgttgcaggtgtactgg

SEQ ID NO: 1116 - DNA, 20 bp, Artificial Sequence
  Description of Artificial Sequence: Synthetic probe
gctgtcagggatcttttcta

SEQ ID NO: 1117 - DNA, 20 bp, Artificial Sequence
  Description of Artificial Sequence: Synthetic probe
ctggaaacgaatttaaatgg

SEQ ID NO: 1118 - DNA, 20 bp, Artificial Sequence
  Description of Artificial Sequence: Synthetic probe
tgtcaaactgcagagcaaca

SEQ ID NO: 1119 - DNA, 20 bp, Artificial Sequence
  Description of Artificial Sequence: Synthetic probe
ctgccgcataaactataaat

SEQ ID NO: 1120 - DNA, 20 bp, Artificial Sequence
  Description of Artificial Sequence: Synthetic probe
ctgtaaggtggtacacagcg

SEQ ID NO: 1121 - DNA, 20 bp, Artificial Sequence
  Description of Artificial Sequence: Synthetic probe
aagccacccaggtctcattc

SEQ ID NO: 1122 - DNA, 20 bp, Artificial Sequence
  Description of Artificial Sequence: Synthetic probe
ctccctgctgttggaggcaa

SEQ ID NO: 1123 - DNA, 20 bp, Artificial Sequence
  Description of Artificial Sequence: Synthetic probe
atgcgcatggcaagaacttg

SEQ ID NO: 1124 - DNA, 20 bp, Artificial Sequence
  Description of Artificial Sequence: Synthetic probe
ccttaccccagattctctat

SEQ ID NO: 1125 - DNA, 20 bp, Artificial Sequence
  Description of Artificial Sequence: Synthetic probe
ccctttgaacaacttcagtg

SEQ ID NO: 1126 - DNA, 20 bp, Artificial Sequence
  Description of Artificial Sequence: Synthetic probe
ctgatcaggtaaccagagcc

SEQ ID NO: 1127 - DNA, 20 bp, Artificial Sequence
  Description of Artificial Sequence: Synthetic probe
taggaagaggccccacattg

SEQ ID NO: 1128 - DNA, 20 bp, Artificial Sequence
  Description of Artificial Sequence: Synthetic probe
gaactaagacaggtttgtca

SEQ ID NO: 1129 - DNA, 20 bp, Artificial Sequence
  Description of Artificial Sequence: Synthetic probe
ctcaagggacttcccagcac

SEQ ID NO: 1130 - DNA, 20 bp, Artificial Sequence
  Description of Artificial Sequence: Synthetic probe
ctacaacaaagacttacagg

SEQ ID NO: 1131 - DNA, 20 bp, Artificial Sequence
  Description of Artificial Sequence: Synthetic probe
tacagtgaagaagacttcac

SEQ ID NO: 1132 - DNA, 20 bp, Artificial Sequence
  Description of Artificial Sequence: Synthetic probe
ctcttcctattgagtttgct

SEQ ID NO: 1133 - DNA, 20 bp, Artificial Sequence
  Description of Artificial Sequence: Synthetic probe
ctcttcaaggtgcaagtaac

SEQ ID NO: 1134 - DNA, 20 bp, Artificial Sequence
  Description of Artificial Sequence: Synthetic probe
cagccagaacatgggctgcc

SEQ ID NO: 1135 - DNA, 20 bp, Artificial Sequence
  Description of Artificial Sequence: Synthetic probe
accagtaactcttgtgttca

SEQ ID NO: 1136 - DNA, 20 bp, Artificial Sequence
  Description of Artificial Sequence: Synthetic probe
ccaggacccagacccttggc

SEQ ID NO: 1137 - DNA, 20 bp, Artificial Sequence
  Description of Artificial Sequence: Synthetic probe
ttcttgaattcatgtacatg

SEQ ID NO: 1138 - DNA, 20 bp, Artificial Sequence
  Description of Artificial Sequence: Synthetic probe
gtattaacacttagtgttcg

SEQ ID NO: 1139 - DNA, 20 bp, Artificial Sequence
  Description of Artificial Sequence: Synthetic probe
caaaagggtccatgtaccac

SEQ ID NO: 1140 - DNA, 20 bp, Artificial Sequence
  Description of Artificial Sequence: Synthetic probe
catgtgctggagcatctgtt

SEQ ID NO: 1141 - DNA, 20 bp, Artificial Sequence
  Description of Artificial Sequence: Synthetic probe
gccttccggggacacatagc

SEQ ID NO: 1142 - DNA, 20 bp, Artificial Sequence
  Description of Artificial Sequence: Synthetic probe
cagagaggaggcaaagaaaa

SEQ ID NO: 1143 - DNA, 20 bp, Artificial Sequence
  Description of Artificial Sequence: Synthetic probe
cccctgagttgggcagccag

SEQ ID NO: 1144 - DNA, 20 bp, Artificial Sequence
  Description of Artificial Sequence: Synthetic probe
gagtgcccccgggaatggat

SEQ ID NO: 1145 - DNA, 20 bp, Artificial Sequence
  Description of Artificial Sequence: Synthetic probe
atgccccgagtgcggaagag

SEQ ID NO: 1146 - DNA, 20 bp, Artificial Sequence
  Description of Artificial Sequence: Synthetic probe
gatttacaaggagctatgtg

SEQ ID NO: 1147 - DNA, 20 bp, Artificial Sequence
  Description of Artificial Sequence: Synthetic probe
gatgcatgtgcgtcaccgtc

SEQ ID NO: 1148 - DNA, 20 bp, Artificial Sequence
  Description of Artificial Sequence: Synthetic probe
cactcctcctactgtatttt

SEQ ID NO: 1149 - DNA, 20 bp, Artificial Sequence
  Description of Artificial Sequence: Synthetic probe
agcttctcccttacccacac

SEQ ID NO: 1150 - DNA, 20 bp, Artificial Sequence
  Description of Artificial Sequence: Synthetic probe
ctatccttttgaggggcttt

SEQ ID NO: 1151 - DNA, 20 bp, Artificial Sequence
  Description of Artificial Sequence: Synthetic probe
cacccagcggcgacattgta

SEQ ID NO: 1152 - DNA, 20 bp, Artificial Sequence
  Description of Artificial Sequence: Synthetic probe
cagactcctctcacctctag

SEQ ID NO: 1153 - DNA, 20 bp, Artificial Sequence
  Description of Artificial Sequence: Synthetic probe
ccgttgacacagcttctctg

SEQ ID NO: 1154 - DNA, 20 bp, Artificial Sequence
  Description of Artificial Sequence: Synthetic probe
gagaccctagaaggcggcat

SEQ ID NO: 1155 - DNA, 20 bp, Artificial Sequence
  Description of Artificial Sequence: Synthetic probe
ctctgtatagggccataatg

SEQ ID NO: 1156 - DNA, 20 bp, Artificial Sequence
  Description of Artificial Sequence: Synthetic probe
gaattctgaagaaatcttgg

SEQ ID NO: 1157 - DNA, 20 bp, Artificial Sequence
  Description of Artificial Sequence: Synthetic probe
gttaaagggccaaaagtatc

SEQ ID NO: 1158 - DNA, 20 bp, Artificial Sequence
  Description of Artificial Sequence: Synthetic probe
caaggttagggttggagcag

SEQ ID NO: 1159 - DNA, 20 bp, Artificial Sequence
  Description of Artificial Sequence: Synthetic probe
ggaagatgctgccgagaagg

SEQ ID NO: 1160 - DNA, 20 bp, Artificial Sequence
  Description of Artificial Sequence: Synthetic probe
cagagacagatgtggaagaa

SEQ ID NO: 1161 - DNA, 20 bp, Artificial Sequence
  Description of Artificial Sequence: Synthetic probe
cacgaagtggacgaactgac

SEQ ID NO: 1162 - DNA, 20 bp, Artificial Sequence
  Description of Artificial Sequence: Synthetic probe
ccagattatcgccgacgtgt

SEQ ID NO: 1163 - DNA, 20 bp, Artificial Sequence
  Description of Artificial Sequence: Synthetic probe
ctagaaacactaggttcttc

SEQ ID NO: 1164 - DNA, 20 bp, Artificial Sequence
  Description of Artificial Sequence: Synthetic probe
ctgtacatacgtgtatatat

SEQ ID NO: 1165 - DNA, 20 bp, Artificial Sequence
  Description of Artificial Sequence: Synthetic probe
cccacccactaatactactg

SEQ ID NO: 1166 - DNA, 20 bp, Artificial Sequence
  Description of Artificial Sequence: Synthetic probe
cacagagtcaggatctcaca

SEQ ID NO: 1167 - DNA, 20 bp, Artificial Sequence
  Description of Artificial Sequence: Synthetic probe
gttcagacagccacatgagg

SEQ ID NO: 1168 - DNA, 20 bp, Artificial Sequence
  Description of Artificial Sequence: Synthetic probe
ggacagtgcagctacaggat

SEQ ID NO: 1169 - DNA, 20 bp, Artificial Sequence
  Description of Artificial Sequence: Synthetic probe
aattaaagctatagagagtc

SEQ ID NO: 1170 - DNA, 20 bp, Artificial Sequence
  Description of Artificial Sequence: Synthetic probe
ccaacaaagaagatgatacc

SEQ ID NO: 1171 - DNA, 20 bp, Artificial Sequence
  Description of Artificial Sequence: Synthetic probe
tgagtcctgagacttttccg

SEQ ID NO: 1172 - DNA, 20 bp, Artificial Sequence
  Description of Artificial Sequence: Synthetic probe
cgtgatggctatgccttgca

SEQ ID NO: 1173 - DNA, 20 bp, Artificial Sequence
  Description of Artificial Sequence: Synthetic probe
ggggtacaggcaccgaagac

SEQ ID NO: 1174 - DNA, 20 bp, Artificial Sequence
  Description of Artificial Sequence: Synthetic probe
caacatccacaggctaacac

SEQ ID NO: 1175 - DNA, 20 bp, Artificial Sequence
  Description of Artificial Sequence: Synthetic probe
gggttgaggttattgtagac

SEQ ID NO: 1176 - DNA, 20 bp, Artificial Sequence
  Description of Artificial Sequence: Synthetic probe
gttagattgcgggcaccgcc

SEQ ID NO: 1177 - DNA, 20 bp, Artificial Sequence
  Description of Artificial Sequence: Synthetic probe
ggtttaccaggatgtagtcc

SEQ ID NO: 1178 - DNA, 20 bp, Artificial Sequence
  Description of Artificial Sequence: Synthetic probe
cactgttgaggagcatctat

SEQ ID NO: 1179 - DNA, 20 bp, Artificial Sequence
  Description of Artificial Sequence: Synthetic probe
tgcctctccactgctagatg

SEQ ID NO: 1180 - DNA, 20 bp, Artificial Sequence
  Description of Artificial Sequence: Synthetic probe
gaacctggaatctctcatct

SEQ ID NO: 1181 - DNA, 20 bp, Artificial Sequence
  Description of Artificial Sequence: Synthetic probe
aatgagctgaagcgccgtgg

SEQ ID NO: 1182 - DNA, 20 bp, Artificial Sequence
  Description of Artificial Sequence: Synthetic probe
gaagagggcatacggagtgg

SEQ ID NO: 1183 - DNA, 20 bp, Artificial Sequence
  Description of Artificial Sequence: Synthetic probe
caagatccgcatgaaggagc

SEQ ID NO: 1184 - DNA, 20 bp, Artificial Sequence
  Description of Artificial Sequence: Synthetic probe
gggaacgccgagagaaggag

SEQ ID NO: 1185 - DNA, 20 bp, Artificial Sequence
  Description of Artificial Sequence: Synthetic probe
acctctgccctgtccaccag

SEQ ID NO: 1186 - DNA, 20 bp, Artificial Sequence
  Description of Artificial Sequence: Synthetic probe
gataagtgacacctaggacc

SEQ ID NO: 1187 - DNA, 20 bp, Artificial Sequence
  Description of Artificial Sequence: Synthetic probe
aaatcagccttccgcaattc

SEQ ID NO: 1188 - DNA, 20 bp, Artificial Sequence
  Description of Artificial Sequence: Synthetic probe
atgtagtttctgggtcttct

SEQ ID NO: 1189 - DNA, 20 bp, Artificial Sequence
  Description of Artificial Sequence: Synthetic probe
catgccagaggctgatgctg

SEQ ID NO: 1190 - DNA, 20 bp, Artificial Sequence
  Description of Artificial Sequence: Synthetic probe
cactgttgatgtcatgtgag

SEQ ID NO: 1191 - DNA, 20 bp, Artificial Sequence
  Description of Artificial Sequence: Synthetic probe
aggaccctctgctgaacctg

SEQ ID NO: 1192 - DNA, 20 bp, Artificial Sequence
  Description of Artificial Sequence: Synthetic probe
gtgtccccactgggctgtga

SEQ ID NO: 1193 - DNA, 20 bp, Artificial Sequence
  Description of Artificial Sequence: Synthetic probe
cctaaaggatcagactgtgg

SEQ ID NO: 1194 - DNA, 20 bp, Artificial Sequence
  Description of Artificial Sequence: Synthetic probe
cattgtaaatgtcaacattc

SEQ ID NO: 1195 - DNA, 20 bp, Artificial Sequence
  Description of Artificial Sequence: Synthetic probe
atgcgacgccaacatcagag

SEQ ID NO: 1196 - DNA, 20 bp, Artificial Sequence
  Description of Artificial Sequence: Synthetic probe
catcctaagggaacgcagtc

SEQ ID NO: 1197 - DNA, 20 bp, Artificial Sequence
  Description of Artificial Sequence: Synthetic probe
agatgccccgacttctttgg

SEQ ID NO: 1198 - DNA, 20 bp, Artificial Sequence
  Description of Artificial Sequence: Synthetic probe
ccagtgatggggaatcagtg

SEQ ID NO: 1199 - DNA, 20 bp, Artificial Sequence
  Description of Artificial Sequence: Synthetic probe
cctggcttttgtcgtggtgg

SEQ ID NO: 1200 - DNA, 20 bp, Artificial Sequence
  Description of Artificial Sequence: Synthetic probe
ctggctcggataaattttcc

SEQ ID NO: 1201 - DNA, 20 bp, Artificial Sequence
  Description of Artificial Sequence: Synthetic probe
ctggctctgtgctgcgggtg

SEQ ID NO: 1202 - DNA, 20 bp, Artificial Sequence
  Description of Artificial Sequence: Synthetic probe
ctctggttggccgactgcga

SEQ ID NO: 1203 - DNA, 20 bp, Artificial Sequence
  Description of Artificial Sequence: Synthetic probe
gcaagaagctggagcgctac

SEQ ID NO: 1204 - DNA, 20 bp, Artificial Sequence
  Description of Artificial Sequence: Synthetic probe
ctgaagggcgagaacccttt

SEQ ID NO: 1205 - DNA, 20 bp, Artificial Sequence
  Description of Artificial Sequence: Synthetic probe
tgaatatgtcaccttgctcc

SEQ ID NO: 1206 - DNA, 20 bp, Artificial Sequence
  Description of Artificial Sequence: Synthetic probe
caagacacggccctctcagg

SEQ ID NO: 1207 - DNA, 20 bp, Artificial Sequence
  Description of Artificial Sequence: Synthetic probe
ctcaggggcttggatatgtg

SEQ ID NO: 1208 - DNA, 20 bp, Artificial Sequence
  Description of Artificial Sequence: Synthetic probe
gaatagtgaactggggccat

SEQ ID NO: 1209 - DNA, 20 bp, Artificial Sequence
  Description of Artificial Sequence: Synthetic probe
aataagattgtaaggtttgc

SEQ ID NO: 1210 - DNA, 20 bp, Artificial Sequence
  Description of Artificial Sequence: Synthetic probe
cctcctcacctgttgccggc

SEQ ID NO: 1211 - DNA, 20 bp, Artificial Sequence
  Description of Artificial Sequence: Synthetic probe
atgcatgcagacctgtactc

SEQ ID NO: 1212 - DNA, 20 bp, Artificial Sequence
  Description of Artificial Sequence: Synthetic probe
cacatgcaacccaacagcag

SEQ ID NO: 1213 - DNA, 20 bp, Artificial Sequence
  Description of Artificial Sequence: Synthetic probe
ccgaattgtttctagttagg

SEQ ID NO: 1214 - DNA, 20 bp, Artificial Sequence
  Description of Artificial Sequence: Synthetic probe
ccacgctcctctgttcagtc

SEQ ID NO: 1215 - DNA, 20 bp, Artificial Sequence
  Description of Artificial Sequence: Synthetic probe
actcggacaatttctgggtg

SEQ ID NO: 1216 - DNA, 20 bp, Artificial Sequence
  Description of Artificial Sequence: Synthetic probe
gtgactgagtacccctttag

SEQ ID NO: 1217 - DNA, 20 bp, Artificial Sequence
  Description of Artificial Sequence: Synthetic probe
acatcgtatttgcggccagc

SEQ ID NO: 1218 - DNA, 20 bp, Artificial Sequence
  Description of Artificial Sequence: Synthetic probe
ctctacacccagtgaatgcc

SEQ ID NO: 1219 - DNA, 20 bp, Artificial Sequence
  Description of Artificial Sequence: Synthetic probe
atggtacctgttcttctatc

SEQ ID NO: 1220 - DNA, 20 bp, Artificial Sequence
  Description of Artificial Sequence: Synthetic probe
caaacctttcaattcatgct

SEQ ID NO: 1221 - DNA, 20 bp, Artificial Sequence
  Description of Artificial Sequence: Synthetic probe
acttaagtggctaaagagat

SEQ ID NO: 1222 - DNA, 20 bp, Artificial Sequence
  Description of Artificial Sequence: Synthetic probe
gagacaaacatgcaggtcgc

SEQ ID NO: 1223 - DNA, 20 bp, Artificial Sequence
  Description of Artificial Sequence: Synthetic probe
cccctctggtgtcatgtcag

SEQ ID NO: 1224 - DNA, 20 bp, Artificial Sequence
  Description of Artificial Sequence: Synthetic probe
gcattttgcaaggaaaagcc

SEQ ID NO: 1225 - DNA, 20 bp, Artificial Sequence
  Description of Artificial Sequence: Synthetic probe
ggtagagtcaggtgagagtc

SEQ ID NO: 1226 - DNA, 20 bp, Artificial Sequence
  Description of Artificial Sequence: Synthetic probe
ccttggtgagtcatttgtac

SEQ ID NO: 1227 - DNA, 20 bp, Artificial Sequence
  Description of Artificial Sequence: Synthetic probe
gccctgccccctacccttgc

SEQ ID NO: 1228 - DNA, 20 bp, Artificial Sequence
  Description of Artificial Sequence: Synthetic probe
cctttaacttattgggactg

SEQ ID NO: 1229 - DNA, 20 bp, Artificial Sequence
  Description of Artificial Sequence: Synthetic probe
cattactactgtacacggac

SEQ ID NO: 1230 - DNA, 20 bp, Artificial Sequence
  Description of Artificial Sequence: Synthetic probe
catcgcctctgtctcctccg

SEQ ID NO: 1231 - DNA, 20 bp, Artificial Sequence
  Description of Artificial Sequence: Synthetic probe
tccgggtgctcttcgccaac

SEQ ID NO: 1232 - DNA, 20 bp, Artificial Sequence
  Description of Artificial Sequence: Synthetic probe
ctggcagctctgttctggta

SEQ ID NO: 1233 - DNA, 20 bp, Artificial Sequence
  Description of Artificial Sequence: Synthetic probe
acgtcttctttctattgatg

SEQ ID NO: 1234 - DNA, 20 bp, Artificial Sequence
  Description of Artificial Sequence: Synthetic probe
gctggatctattttcaggcc

SEQ ID NO: 1235 - DNA, 20 bp, Artificial Sequence
  Description of Artificial Sequence: Synthetic probe
gttggctgttagtgtatttg

SEQ ID NO: 1236 - DNA, 20 bp, Artificial Sequence
  Description of Artificial Sequence: Synthetic probe
atattctgcctgtctcctca

SEQ ID NO: 1237 - DNA, 20 bp, Artificial Sequence
  Description of Artificial Sequence: Synthetic probe
cagctcatgacaatctgtag

SEQ ID NO: 1238 - DNA, 20 bp, Artificial Sequence
  Description of Artificial Sequence: Synthetic probe
gataacaatcagtgtggatt

SEQ ID NO: 1239 - DNA, 20 bp, Artificial Sequence
  Description of Artificial Sequence: Synthetic probe
ggaaataccgggaacccaag

SEQ ID NO: 1240 - DNA, 20 bp, Artificial Sequence
  Description of Artificial Sequence: Synthetic probe
gaccggagcgaatgaggcct

SEQ ID NO: 1241 - DNA, 20 bp, Artificial Sequence
  Description of Artificial Sequence: Synthetic probe
ttccactcattcctgttgtc

SEQ ID NO: 1242 - DNA, 20 bp, Artificial Sequence
  Description of Artificial Sequence: Synthetic probe
ctaccaccccttgctctttg

SEQ ID NO: 1243 - DNA, 20 bp, Artificial Sequence
  Description of Artificial Sequence: Synthetic probe
gtgtgcataaactgttagtc

SEQ ID NO: 1244 - DNA, 20 bp, Artificial Sequence
  Description of Artificial Sequence: Synthetic probe
gtgactgacttggtgtgttg

SEQ ID NO: 1245 - DNA, 20 bp, Artificial Sequence
  Description of Artificial Sequence: Synthetic probe
tacttccaagcctgtccatg

SEQ ID NO: 1246 - DNA, 20 bp, Artificial Sequence
  Description of Artificial Sequence: Synthetic probe
gatatatcaaatgtcttcac

SEQ ID NO: 1247 - DNA, 20 bp, Artificial Sequence
  Description of Artificial Sequence: Synthetic probe
tgaaaggtggggggtgagtc

SEQ ID NO: 1248 - DNA, 20 bp, Artificial Sequence
  Description of Artificial Sequence: Synthetic probe
ccacttgagcgcttcctgtt

SEQ ID NO: 1249 - DNA, 20 bp, Artificial Sequence
  Description of Artificial Sequence: Synthetic probe
tcttcacatactgtacatac

SEQ ID NO: 1250 - DNA, 20 bp, Artificial Sequence
  Description of Artificial Sequence: Synthetic probe
ctgtgaccactcttgggagt

SEQ ID NO: 1251 - DNA, 20 bp, Artificial Sequence
  Description of Artificial Sequence: Synthetic probe
accaacaaagatgaagttcc

SEQ ID NO: 1252 - DNA, 20 bp, Artificial Sequence
  Description of Artificial Sequence: Synthetic probe
ctatctacggaaaggcatga

SEQ ID NO: 1253 - DNA, 20 bp, Artificial Sequence
  Description of Artificial Sequence: Synthetic probe
agccaattccatttatagac

SEQ ID NO: 1254 - DNA, 20 bp, Artificial Sequence
  Description of Artificial Sequence: Synthetic probe
cacctccagccagtgacgct

SEQ ID NO: 1255 - DNA, 20 bp, Artificial Sequence
  Description of Artificial Sequence: Synthetic probe
ccaggcaatcttgccttctg

SEQ ID NO: 1256 - DNA, 20 bp, Artificial Sequence
  Description of Artificial Sequence: Synthetic probe
gtttcttccagccacattga

SEQ ID NO: 1257 - DNA, 20 bp, Artificial Sequence
  Description of Artificial Sequence: Synthetic probe
tttgttggagaagaaagttg

SEQ ID NO: 1258 - DNA, 20 bp, Artificial Sequence
  Description of Artificial Sequence: Synthetic probe
gagtaggagactttcacaag

SEQ ID NO: 1259 - DNA, 20 bp, Artificial Sequence
  Description of Artificial Sequence: Synthetic probe
gatttattctaagagaagtg

SEQ ID NO: 1260 - DNA, 20 bp, Artificial Sequence
  Description of Artificial Sequence: Synthetic probe
catgtgaagaatggttgcca

SEQ ID NO: 1261 - DNA, 20 bp, Artificial Sequence
  Description of Artificial Sequence: Synthetic probe
accgatcaagatgagttcag

SEQ ID NO: 1262 - DNA, 20 bp, Artificial Sequence
  Description of Artificial Sequence: Synthetic probe
ctagaagtcataccaccctc

SEQ ID NO: 1263 - DNA, 20 bp, Artificial Sequence
  Description of Artificial Sequence: Synthetic probe
aaactcaccatccctcagtc

SEQ ID NO: 1264 - DNA, 20 bp, Artificial Sequence
  Description of Artificial Sequence: Synthetic probe
ctccccaacagggtactagg

SEQ ID NO: 1265 - DNA, 20 bp, Artificial Sequence
  Description of Artificial Sequence: Synthetic probe
ggagactttctatgcccttg

SEQ ID NO: 1266 - DNA, 20 bp, Artificial Sequence
  Description of Artificial Sequence: Synthetic probe
gtccgtatttttaacagaag

SEQ ID NO: 1267 - DNA, 20 bp, Artificial Sequence
  Description of Artificial Sequence: Synthetic probe
tgcgatgtttcaggaggctg

SEQ ID NO: 1268 - DNA, 20 bp, Artificial Sequence
  Description of Artificial Sequence: Synthetic probe
gaggaaggggggttgcagtg

SEQ ID NO: 1269 - DNA, 20 bp, Artificial Sequence
  Description of Artificial Sequence: Synthetic probe
ggccatcattctcactgtac

SEQ ID NO: 1270 - DNA, 20 bp, Artificial Sequence
  Description of Artificial Sequence: Synthetic probe
cactaggcgcagttggatat

SEQ ID NO: 1271 - DNA, 20 bp, Artificial Sequence
  Description of Artificial Sequence: Synthetic probe
tgagtgagccaccagctctc

SEQ ID NO: 1272 - DNA, 20 bp, Artificial Sequence
  Description of Artificial Sequence: Synthetic probe
cacgttcccctcatagcagt

SEQ ID NO: 1273 - DNA, 20 bp, Artificial Sequence
  Description of Artificial Sequence: Synthetic probe
gacagttcttctggggttgg

SEQ ID NO: 1274 - DNA, 20 bp, Artificial Sequence
  Description of Artificial Sequence: Synthetic probe
cagctgctcattcatgatgg

SEQ ID NO: 1275 - DNA, 20 bp, Artificial Sequence
  Description of Artificial Sequence: Synthetic probe
gcggggtcctttgccgttgg

SEQ ID NO: 1276 - DNA, 20 bp, Artificial Sequence
  Description of Artificial Sequence: Synthetic probe
cttctagtgctagtaatcat

SEQ ID NO: 1277 - DNA, 20 bp, Artificial Sequence
  Description of Artificial Sequence: Synthetic probe
ggcggaagtacttccctcag

SEQ ID NO: 1278 - DNA, 20 bp, Artificial Sequence
  Description of Artificial Sequence: Synthetic probe
gcctatgcaaaaagaggatc

SEQ ID NO: 1279 - DNA, 20 bp, Artificial Sequence
  Description of Artificial Sequence: Synthetic probe
ttgtccattgctagaacaac

SEQ ID NO: 1280 - DNA, 20 bp, Artificial Sequence
  Description of Artificial Sequence: Synthetic probe
cgaatatagtacacgacctt

SEQ ID NO: 1281 - DNA, 20 bp, Artificial Sequence
  Description of Artificial Sequence: Synthetic probe
gttcagtggtatgagcagag

SEQ ID NO: 1282 - DNA, 20 bp, Artificial Sequence
  Description of Artificial Sequence: Synthetic probe
gaagagatcccagatagtag

SEQ ID NO: 1283 - DNA, 20 bp, Artificial Sequence
  Description of Artificial Sequence: Synthetic probe
aagcgaggcagtgctaccag

SEQ ID NO: 1284 - DNA, 20 bp, Artificial Sequence
  Description of Artificial Sequence: Synthetic probe
cagctccaacaccagcctca

SEQ ID NO: 1285 - DNA, 20 bp, Artificial Sequence
  Description of Artificial Sequence: Synthetic probe
cgttcatggtggtctttcag

SEQ ID NO: 1286 - DNA, 20 bp, Artificial Sequence
  Description of Artificial Sequence: Synthetic probe
gttatcttggcaacatgtac

SEQ ID NO: 1287 - DNA, 20 bp, Artificial Sequence
  Description of Artificial Sequence: Synthetic probe
gtgatgaagaaaatcattga

SEQ ID NO: 1288 - DNA, 20 bp, Artificial Sequence
  Description of Artificial Sequence: Synthetic probe
gactgttgcagaaggagggg

SEQ ID NO: 1289 - DNA, 20 bp, Artificial Sequence
  Description of Artificial Sequence: Synthetic probe
gaccctggtgggggtggctc

SEQ ID NO: 1290 - DNA, 20 bp, Artificial Sequence
  Description of Artificial Sequence: Synthetic probe
cttctcactgctggatccgg

SEQ ID NO: 1291 - DNA, 20 bp, Artificial Sequence
  Description of Artificial Sequence: Synthetic probe
agaatgggactgtgaactgg

SEQ ID NO: 1292 - DNA, 20 bp, Artificial Sequence
  Description of Artificial Sequence: Synthetic probe
gtactcttaccatgcagaca

SEQ ID NO: 1293 - DNA, 20 bp, Artificial Sequence
  Description of Artificial Sequence: Synthetic probe
atagaccagaaaaatcctgg

SEQ ID NO: 1294 - DNA, 20 bp, Artificial Sequence
  Description of Artificial Sequence: Synthetic probe
cagcttttctccaggcatct

SEQ ID NO: 1295 - DNA, 20 bp, Artificial Sequence
  Description of Artificial Sequence: Synthetic probe
tctcagtccctggccatgtg

SEQ ID NO: 1296 - DNA, 20 bp, Artificial Sequence
  Description of Artificial Sequence: Synthetic probe
gtcaaggtggctttctgtta

SEQ ID NO: 1297 - DNA, 20 bp, Artificial Sequence
  Description of Artificial Sequence: Synthetic probe
gccctgctgtgtcagtttcc

SEQ ID NO: 1298 - DNA, 20 bp, Artificial Sequence
  Description of Artificial Sequence: Synthetic probe
ctgtggccttttgaactgta

SEQ ID NO: 1299 - DNA, 20 bp, Artificial Sequence
  Description of Artificial Sequence: Synthetic probe
acttgggctagagcagaagg

SEQ ID NO: 1300 - DNA, 20 bp, Artificial Sequence
  Description of Artificial Sequence: Synthetic probe
cataggccagggtggttatt

SEQ ID NO: 1301 - DNA, 20 bp, Artificial Sequence
  Description of Artificial Sequence: Synthetic probe
tctcccgatttgagggcttg

SEQ ID NO: 1302 - DNA, 20 bp, Artificial Sequence
  Description of Artificial Sequence: Synthetic probe
gagaagatctctgcctacat

SEQ ID NO: 1303 - DNA, 20 bp, Artificial Sequence
  Description of Artificial Sequence: Synthetic probe
ttctcttcaggaagaaaaag

SEQ ID NO: 1304 - DNA, 20 bp, Artificial Sequence
  Description of Artificial Sequence: Synthetic probe
catcagggggaaatggaatg

SEQ ID NO: 1305 - DNA, 20 bp, Artificial Sequence
  Description of Artificial Sequence: Synthetic probe
gtgtcagcgcctggcctacc

SEQ ID NO: 1306 - DNA, 20 bp, Artificial Sequence
  Description of Artificial Sequence: Synthetic probe
cagattgtatcatgtgctag

SEQ ID NO: 1307 - DNA, 20 bp, Artificial Sequence
  Description of Artificial Sequence: Synthetic probe
acgtcgggtgacacttgatg

SEQ ID NO: 1308 - DNA, 20 bp, Artificial Sequence
  Description of Artificial Sequence: Synthetic probe
gaaaggtgcagtatcttgtg

SEQ ID NO: 1309 - DNA, 20 bp, Artificial Sequence
  Description of Artificial Sequence: Synthetic probe
ggctcccttctctttgatag

SEQ ID NO: 1310 - DNA, 20 bp, Artificial Sequence
  Description of Artificial Sequence: Synthetic probe
cagttataatgcccttgttc

SEQ ID NO: 1311 - DNA, 20 bp, Artificial Sequence
  Description of Artificial Sequence: Synthetic probe
ggtgtctggtaggcaaactg

SEQ ID NO: 1312 - DNA, 20 bp, Artificial Sequence
  Description of Artificial Sequence: Synthetic probe
caaggcagttgagatagttg

SEQ ID NO: 1313 - DNA, 20 bp, Artificial Sequence
  Description of Artificial Sequence: Synthetic probe
gatgcccaggatttgactcg

SEQ ID NO: 1314 - DNA, 20 bp, Artificial Sequence
  Description of Artificial Sequence: Synthetic probe
ggccttagaactttgcatag

SEQ ID NO: 1315 - DNA, 20 bp, Artificial Sequence
  Description of Artificial Sequence: Synthetic probe
tttccttcatattatcaatg

SEQ ID NO: 1316 - DNA, 20 bp, Artificial Sequence
  Description of Artificial Sequence: Synthetic probe
cttatatattccttagacta

SEQ ID NO: 1317 - DNA, 20 bp, Artificial Sequence
  Description of Artificial Sequence: Synthetic probe
ctttgtgggactggtggaag

SEQ ID NO: 1318 - DNA, 20 bp, Artificial Sequence
  Description of Artificial Sequence: Synthetic probe
caggacacctggaactgcgg

SEQ ID NO: 1319 - DNA, 20 bp, Artificial Sequence
  Description of Artificial Sequence: Synthetic probe
ggtgattaaaattcctaatg

SEQ ID NO: 1320 - DNA, 20 bp, Artificial Sequence
  Description of Artificial Sequence: Synthetic probe
gtttgggagcaatactttct

SEQ ID NO: 1321 - DNA, 20 bp, Artificial Sequence
  Description of Artificial Sequence: Synthetic probe
gcttggcgtctgccggtctc

SEQ ID NO: 1322 - DNA, 20 bp, Artificial Sequence
  Description of Artificial Sequence: Synthetic probe
catccccttgttcgggagga

SEQ ID NO: 1323 - DNA, 20 bp, Artificial Sequence
  Description of Artificial Sequence: Synthetic probe
tgattcctttatgatgactg

SEQ ID NO: 1324 - DNA, 20 bp, Artificial Sequence
  Description of Artificial Sequence: Synthetic probe
cttaactccccactgcctgt

SEQ ID NO: 1325 - DNA, 20 bp, Artificial Sequence
  Description of Artificial Sequence: Synthetic probe
gcttcggcatttgatcagac

SEQ ID NO: 1326 - DNA, 20 bp, Artificial Sequence
  Description of Artificial Sequence: Synthetic probe
caaacagtgctgtttcccgg

SEQ ID NO: 1327 - DNA, 20 bp, Artificial Sequence
  Description of Artificial Sequence: Synthetic probe
ggagtccgagaaggaaaatg

SEQ ID NO: 1328 - DNA, 20 bp, Artificial Sequence
  Description of Artificial Sequence: Synthetic probe
gaattctggttcatactgtg

SEQ ID NO: 1329 - DNA, 20 bp, Artificial Sequence
  Description of Artificial Sequence: Synthetic probe
ccacatggttaaatgcatac

SEQ ID NO: 1330 - DNA, 20 bp, Artificial Sequence
  Description of Artificial Sequence: Synthetic probe
cttcccagtactggggggaa

SEQ ID NO: 1331 - DNA, 20 bp, Artificial Sequence
  Description of Artificial Sequence: Synthetic probe
ctagcctggctcaaatattc

SEQ ID NO: 1332 - DNA, 20 bp, Artificial Sequence
  Description of Artificial Sequence: Synthetic probe
cccagggagactgctgtgtg

SEQ ID NO: 1333 - DNA, 20 bp, Artificial Sequence
  Description of Artificial Sequence: Synthetic probe
tacagtggactttctctctg

SEQ ID NO: 1334 - DNA, 20 bp, Artificial Sequence
  Description of Artificial Sequence: Synthetic probe
gaatggaaccttcttaggcc

SEQ ID NO: 1335 - DNA, 20 bp, Artificial Sequence
  Description of Artificial Sequence: Synthetic probe
agcagagctgtcacagtgtg

SEQ ID NO: 1336 - DNA, 20 bp, Artificial Sequence
  Description of Artificial Sequence: Synthetic probe
cactaccttagattgtttta

SEQ ID NO: 1337 - DNA, 20 bp, Artificial Sequence
  Description of Artificial Sequence: Synthetic probe
tctcccttctttcatcttgg

SEQ ID NO: 1338 - DNA, 20 bp, Artificial Sequence
  Description of Artificial Sequence: Synthetic probe
ggttgggtagagaaacacaa

SEQ ID NO: 1339 - DNA, 20 bp, Artificial Sequence
  Description of Artificial Sequence: Synthetic probe
actatgttagttgcatttag

SEQ ID NO: 1340 - DNA, 20 bp, Artificial Sequence
  Description of Artificial Sequence: Synthetic probe
gttttaaagcaaagaatctg

SEQ ID NO: 1341 - DNA, 20 bp, Artificial Sequence
  Description of Artificial Sequence: Synthetic probe
aggagatcaacaaacggaag

SEQ ID NO: 1342 - DNA, 20 bp, Artificial Sequence
  Description of Artificial Sequence: Synthetic probe
cagctgatcctggaggggaa

SEQ ID NO: 1343 - DNA, 20 bp, Artificial Sequence
  Description of Artificial Sequence: Synthetic probe
ggtcttgggagctcttggag

SEQ ID NO: 1344 - DNA, 20 bp, Artificial Sequence
  Description of Artificial Sequence: Synthetic probe
gtgtctgtatcagtggattt

SEQ ID NO: 1345 - DNA, 20 bp, Artificial Sequence
  Description of Artificial Sequence: Synthetic probe
accaaggagcagtgggacac

SEQ ID NO: 1346 - DNA, 20 bp, Artificial Sequence
  Description of Artificial Sequence: Synthetic probe
catagaagaactcatcagga

SEQ ID NO: 1347 - DNA, 20 bp, Artificial Sequence
  Description of Artificial Sequence: Synthetic probe
gaaatgtttagggacatctc

SEQ ID NO: 1348 - DNA, 20 bp, Artificial Sequence
  Description of Artificial Sequence: Synthetic probe
catgctgtcacttgtgattt

SEQ ID NO: 1349 - DNA, 20 bp, Artificial Sequence
  Description of Artificial Sequence: Synthetic probe
ccgctggcctactgtgaagg

SEQ ID NO: 1350 - DNA, 20 bp, Artificial Sequence
  Description of Artificial Sequence: Synthetic probe
gagatgacctgtgattagac

SEQ ID NO: 1351 - DNA, 20 bp, Artificial Sequence
  Description of Artificial Sequence: Synthetic probe
gaatgggtcagcatatctct

SEQ ID NO: 1352 - DNA, 20 bp, Artificial Sequence
  Description of Artificial Sequence: Synthetic probe
gtttgcatggtttgcaggag

SEQ ID NO: 1353 - DNA, 20 bp, Artificial Sequence
  Description of Artificial Sequence: Synthetic probe
cggcagagaatcccccacac

SEQ ID NO: 1354 - DNA, 20 bp, Artificial Sequence
  Description of Artificial Sequence: Synthetic probe
gctctgaaggacccactttc

SEQ ID NO: 1355 - DNA, 20 bp, Artificial Sequence
  Description of Artificial Sequence: Synthetic probe
ggaacccacagacctcacac

SEQ ID NO: 1356 - DNA, 20 bp, Artificial Sequence
  Description of Artificial Sequence: Synthetic probe
ctgggggacagaggcagata

SEQ ID NO: 1357 - DNA, 20 bp, Artificial Sequence
  Description of Artificial Sequence: Synthetic probe
cactgcatcgggttgtctgg

SEQ ID NO: 1358 - DNA, 20 bp, Artificial Sequence
  Description of Artificial Sequence: Synthetic probe
cgcccttttcctccagccta

SEQ ID NO: 1359 - DNA, 20 bp, Artificial Sequence
  Description of Artificial Sequence: Synthetic probe
ctgttccctcaccctgtatc

SEQ ID NO: 1360 - DNA, 20 bp, Artificial Sequence
  Description of Artificial Sequence: Synthetic probe
ctgtctcccctaattgacat

SEQ ID NO: 1361 - DNA, 20 bp, Artificial Sequence
  Description of Artificial Sequence: Synthetic probe
tgagttgaagcatgaaaatg

SEQ ID NO: 1362 - DNA, 20 bp, Artificial Sequence
  Description of Artificial Sequence: Synthetic probe
gtgcccatgcctgacgctcc

SEQ ID NO: 1363 - DNA, 20 bp, Artificial Sequence
  Description of Artificial Sequence: Synthetic probe
caattcctcaagtctgggtg

SEQ ID NO: 1364 - DNA, 20 bp, Artificial Sequence
  Description of Artificial Sequence: Synthetic probe
gtgacaaggtaggggctagg

SEQ ID NO: 1365 - DNA, 20 bp, Artificial Sequence
  Description of Artificial Sequence: Synthetic probe
ggtttccagcccccagtgtc

SEQ ID NO: 1366 - DNA, 20 bp, Artificial Sequence
  Description of Artificial Sequence: Synthetic probe
ctgacttctgtctgccacat

SEQ ID NO: 1367 - DNA, 20 bp, Artificial Sequence
  Description of Artificial Sequence: Synthetic probe
cagtagccaccatgttcaac

SEQ ID NO: 1368 - DNA, 20 bp, Artificial Sequence
  Description of Artificial Sequence: Synthetic probe
catctgtcatgactgtttgg

SEQ ID NO: 1369 - DNA, 20 bp, Artificial Sequence
  Description of Artificial Sequence: Synthetic probe
ccagccccgatgcaggagag

SEQ ID NO: 1370 - DNA, 20 bp, Artificial Sequence
  Description of Artificial Sequence: Synthetic probe
ctgtcccttgcttccagatt

SEQ ID NO: 1371 - DNA, 20 bp, Artificial Sequence
  Description of Artificial Sequence: Synthetic probe
gccaagaaccagggggccat

SEQ ID NO: 1372 - DNA, 20 bp, Artificial Sequence
  Description of Artificial Sequence: Synthetic probe
caaaagcatcgggatttggc

SEQ ID NO: 1373 - DNA, 20 bp, Artificial Sequence
  Description of Artificial Sequence: Synthetic probe
tgcagtggctgaacaaagag

SEQ ID NO: 1374 - DNA, 20 bp, Artificial Sequence
  Description of Artificial Sequence: Synthetic probe
catggcttgagaatcaaagg

SEQ ID NO: 1375 - DNA, 20 bp, Artificial Sequence
  Description of Artificial Sequence: Synthetic probe
aaacaggaccagttacactc

SEQ ID NO: 1376 - DNA, 20 bp, Artificial Sequence
  Description of Artificial Sequence: Synthetic probe
catacgcaaaccgcgataca

SEQ ID NO: 1377 - DNA, 20 bp, Artificial Sequence
  Description of Artificial Sequence: Synthetic probe
tactacctagagaaagccag

SEQ ID NO: 1378 - DNA, 20 bp, Artificial Sequence
  Description of Artificial Sequence: Synthetic probe
caaagaatgaaggcaacaaa

SEQ ID NO: 1379 - DNA, 20 bp, Artificial Sequence
  Description of Artificial Sequence: Synthetic probe
attgatgctgcctcattcac

SEQ ID NO: 1380 - DNA, 20 bp, Artificial Sequence
  Description of Artificial Sequence: Synthetic probe
gctgacattctttggtcaag

SEQ ID NO: 1381 - DNA, 20 bp, Artificial Sequence
  Description of Artificial Sequence: Synthetic probe
cctaggtgccctgggaattg

SEQ ID NO: 1382 - DNA, 20 bp, Artificial Sequence
  Description of Artificial Sequence: Synthetic probe
caaacagctttctggatgaa

SEQ ID NO: 1383 - DNA, 20 bp, Artificial Sequence
  Description of Artificial Sequence: Synthetic probe
agaaacagaagagctccaag

SEQ ID NO: 1384 - DNA, 20 bp, Artificial Sequence
  Description of Artificial Sequence: Synthetic probe
ctaatgcctgcaccaatcca

SEQ ID NO: 1385 - DNA, 20 bp, Artificial Sequence
  Description of Artificial Sequence: Synthetic probe
taggacttaagctgatgaag

SEQ ID NO: 1386 - DNA, 20 bp, Artificial Sequence
  Description of Artificial Sequence: Synthetic probe
cttggctcctagtgattggt

SEQ ID NO: 1387 - DNA, 20 bp, Artificial Sequence
  Description of Artificial Sequence: Synthetic probe
agttcttgtcctggttctag

SEQ ID NO: 1388 - DNA, 20 bp, Artificial Sequence
  Description of Artificial Sequence: Synthetic probe
ctgctcacatgtacaaatca

SEQ ID NO: 1389 - DNA, 20 bp, Artificial Sequence
  Description of Artificial Sequence: Synthetic probe
atatgtaatggggttgaaag

SEQ ID NO: 1390 - DNA, 20 bp, Artificial Sequence
  Description of Artificial Sequence: Synthetic probe
ctggggaggaggatctactg

SEQ ID NO: 1391 - DNA, 20 bp, Artificial Sequence
  Description of Artificial Sequence: Synthetic probe
tcagtgactccgagctgcag

SEQ ID NO: 1392 - DNA, 20 bp, Artificial Sequence
  Description of Artificial Sequence: Synthetic probe
cactccaaggctgtcagggc

SEQ ID NO: 1393 - DNA, 20 bp, Artificial Sequence
  Description of Artificial Sequence: Synthetic probe
ccttctcagtcaagtctgcc

SEQ ID NO: 1394 - DNA, 20 bp, Artificial Sequence
  Description of Artificial Sequence: Synthetic probe
ggatgtctttctttacctac

SEQ ID NO: 1395 - DNA, 20 bp, Artificial Sequence
  Description of Artificial Sequence: Synthetic probe
atctgttcaggttggtgtac

SEQ ID NO: 1396 - DNA, 20 bp, Artificial Sequence
  Description of Artificial Sequence: Synthetic probe
cgtgtaaagtggggatgggg

SEQ ID NO: 1397 - DNA, 20 bp, Artificial Sequence
  Description of Artificial Sequence: Synthetic probe
ccttgtaagaaaaaatgctg

SEQ ID NO: 1398 - DNA, 20 bp, Artificial Sequence
  Description of Artificial Sequence: Synthetic probe
ggtaatgtacctggtaacaa

SEQ ID NO: 1399 - DNA, 20 bp, Artificial Sequence
  Description of Artificial Sequence: Synthetic probe
caaggctaagattagaacag

SEQ ID NO: 1400 - DNA, 20 bp, Artificial Sequence
  Description of Artificial Sequence: Synthetic probe
ctcataggagagtcatgatt

SEQ ID NO: 1401 - DNA, 20 bp, Artificial Sequence
  Description of Artificial Sequence: Synthetic probe
ccacccaaatccaactcatc

SEQ ID NO: 1402 - DNA, 20 bp, Artificial Sequence
  Description of Artificial Sequence: Synthetic probe
ctggtttgctgcacactggt

SEQ ID NO: 1403 - DNA, 20 bp, Artificial Sequence
  Description of Artificial Sequence: Synthetic probe
gggagaagaagagttcctgc

SEQ ID NO: 1404 - DNA, 20 bp, Artificial Sequence
  Description of Artificial Sequence: Synthetic probe
gcatgcaagccctgctgtgt

SEQ ID NO: 1405 - DNA, 20 bp, Artificial Sequence
  Description of Artificial Sequence: Synthetic probe
gctaaggggttactggggag

SEQ ID NO: 1406 - DNA, 20 bp, Artificial Sequence
  Description of Artificial Sequence: Synthetic probe
gaccagcgtttctgcgcaag

SEQ ID NO: 1407 - DNA, 20 bp, Artificial Sequence
  Description of Artificial Sequence: Synthetic probe
ccttccttggctctttttag

SEQ ID NO: 1408 - DNA, 20 bp, Artificial Sequence
  Description of Artificial Sequence: Synthetic probe
cttgtggcggcagtgggcag

SEQ ID NO: 1409 - DNA, 20 bp, Artificial Sequence
  Description of Artificial Sequence: Synthetic probe
ttgcaggatgagttgggcag

SEQ ID NO: 1410 - DNA, 20 bp, Artificial Sequence
  Description of Artificial Sequence: Synthetic probe
ggaaaagggtcagggttcat

SEQ ID NO: 1411 - DNA, 20 bp, Artificial Sequence
  Description of Artificial Sequence: Synthetic probe
gcccagcccttcttctagtg

SEQ ID NO: 1412 - DNA, 20 bp, Artificial Sequence
  Description of Artificial Sequence: Synthetic probe
gtagctctggctttgcaggc

SEQ ID NO: 1413 - DNA, 20 bp, Artificial Sequence
  Description of Artificial Sequence: Synthetic probe
tgattcggacaaccatgagg

SEQ ID NO: 1414 - DNA, 20 bp, Artificial Sequence
  Description of Artificial Sequence: Synthetic probe
ggtagtggtgctagggagaa

SEQ ID NO: 1415 - DNA, 20 bp, Artificial Sequence
  Description of Artificial Sequence: Synthetic probe
aggccaaaaccatgtgggtg

SEQ ID NO: 1416 - DNA, 20 bp, Artificial Sequence
  Description of Artificial Sequence: Synthetic probe
cacaaagccaggcactgcca

SEQ ID NO: 1417 - DNA, 20 bp, Artificial Sequence
  Description of Artificial Sequence: Synthetic probe
caaaggatttatatagtgtg

SEQ ID NO: 1418 - DNA, 20 bp, Artificial Sequence
  Description of Artificial Sequence: Synthetic probe
ctcccactaactgtacagat

SEQ ID NO: 1419 - DNA, 20 bp, Artificial Sequence
  Description of Artificial Sequence: Synthetic probe
gaactaacgctgcgtccttg

SEQ ID NO: 1420 - DNA, 20 bp, Artificial Sequence
  Description of Artificial Sequence: Synthetic probe
gaatgaatgatgcgtgagtt

SEQ ID NO: 1421 - DNA, 20 bp, Artificial Sequence
  Description of Artificial Sequence: Synthetic probe
attcccttccagttaactac

SEQ ID NO: 1422 - DNA, 20 bp, Artificial Sequence
  Description of Artificial Sequence: Synthetic probe
ctctccaagggaaaccacta

SEQ ID NO: 1423 - DNA, 20 bp, Artificial Sequence
  Description of Artificial Sequence: Synthetic probe
tgcccctcaccccaatgttc

SEQ ID NO: 1424 - DNA, 20 bp, Artificial Sequence
  Description of Artificial Sequence: Synthetic probe
cacaccatcgacaaccaagg

SEQ ID NO: 1425 - DNA, 20 bp, Artificial Sequence
  Description of Artificial Sequence: Synthetic probe
tcacgtcctcatctcatttg

SEQ ID NO: 1426 - DNA, 20 bp, Artificial Sequence
  Description of Artificial Sequence: Synthetic probe
gctgtgtaaagaaatgggaa

SEQ ID NO: 1427 - DNA, 20 bp, Artificial Sequence
  Description of Artificial Sequence: Synthetic probe
gaagtacattactgcccatg

SEQ ID NO: 1428 - DNA, 20 bp, Artificial Sequence
  Description of Artificial Sequence: Synthetic probe
gactgccgcccactgcctca

SEQ ID NO: 1429 - DNA, 20 bp, Artificial Sequence
  Description of Artificial Sequence: Synthetic probe
cagcagaagctggtaaaaac

SEQ ID NO: 1430 - DNA, 20 bp, Artificial Sequence
  Description of Artificial Sequence: Synthetic probe
atggggagcccggaggacag

SEQ ID NO: 1431 - DNA, 20 bp, Artificial Sequence
  Description of Artificial Sequence: Synthetic probe
tgtggatgaaatagaagctg

SEQ ID NO: 1432 - DNA, 20 bp, Artificial Sequence
  Description of Artificial Sequence: Synthetic probe
gagccctcctcttggaatat

SEQ ID NO: 1433 - DNA, 20 bp, Artificial Sequence
  Description of Artificial Sequence: Synthetic probe
atcagtacacagaagagacg

SEQ ID NO: 1434 - DNA, 20 bp, Artificial Sequence
  Description of Artificial Sequence: Synthetic probe
gatgtgaagacaccaagaga

SEQ ID NO: 1435 - DNA, 20 bp, Artificial Sequence
  Description of Artificial Sequence: Synthetic probe
gccttttcagcttgaccctg

SEQ ID NO: 1436 - DNA, 20 bp, Artificial Sequence
  Description of Artificial Sequence: Synthetic probe
caatataacatgcacaggcc

SEQ ID NO: 1437 - DNA, 20 bp, Artificial Sequence
  Description of Artificial Sequence: Synthetic probe
tgcgtcctgggtagtctgtg

SEQ ID NO: 1438 - DNA, 20 bp, Artificial Sequence
  Description of Artificial Sequence: Synthetic probe
cttgtaatccagcatgtttc

SEQ ID NO: 1439 - DNA, 20 bp, Artificial Sequence
  Description of Artificial Sequence: Synthetic probe
cctccactagttctttgtag

SEQ ID NO: 1440 - DNA, 20 bp, Artificial Sequence
  Description of Artificial Sequence: Synthetic probe
cagagtacataactacataa

SEQ ID NO: 1441 - DNA, 20 bp, Artificial Sequence
  Description of Artificial Sequence: Synthetic probe
ataactggagaaagaagctc

SEQ ID NO: 1442 - DNA, 20 bp, Artificial Sequence
  Description of Artificial Sequence: Synthetic probe
cattgaccgaagccacaggg

SEQ ID NO: 1443 - DNA, 20 bp, Artificial Sequence
  Description of Artificial Sequence: Synthetic probe
aatcggccacacctggtgtc

SEQ ID NO: 1444 - DNA, 20 bp, Artificial Sequence
  Description of Artificial Sequence: Synthetic probe
catgggcagcctggtgcaat

SEQ ID NO: 1445 - DNA, 20 bp, Artificial Sequence
  Description of Artificial Sequence: Synthetic probe
ccttccagtatgagtatgag

SEQ ID NO: 1446 - DNA, 20 bp, Artificial Sequence
  Description of Artificial Sequence: Synthetic probe
ccaccctgcacgtccctctg

SEQ ID NO: 1447 - DNA, 20 bp, Artificial Sequence
  Description of Artificial Sequence: Synthetic probe
ttgagctgccggttatacac

SEQ ID NO: 1448 - DNA, 20 bp, Artificial Sequence
  Description of Artificial Sequence: Synthetic probe
caaaatgttctgttcagtac

SEQ ID NO: 1449 - DNA, 20 bp, Artificial Sequence
  Description of Artificial Sequence: Synthetic probe
tcaggagcccccaacacagg

SEQ ID NO: 1450 - DNA, 20 bp, Artificial Sequence
  Description of Artificial Sequence: Synthetic probe
caagtccaccccataataac

SEQ ID NO: 1451 - DNA, 20 bp, Artificial Sequence
  Description of Artificial Sequence: Synthetic probe
ttgctcctatggctccattc

SEQ ID NO: 1452 - DNA, 20 bp, Artificial Sequence
  Description of Artificial Sequence: Synthetic probe
ctgtggtggaagacgtgatg

SEQ ID NO: 1453 - DNA, 20 bp, Artificial Sequence
  Description of Artificial Sequence: Synthetic probe
cctaatcactccaaccctgc

SEQ ID NO: 1454 - DNA, 20 bp, Artificial Sequence
  Description of Artificial Sequence: Synthetic probe
ccctttctgtcccatccttc

SEQ ID NO: 1455 - DNA, 20 bp, Artificial Sequence
  Description of Artificial Sequence: Synthetic probe
ctttcctggttgcagataac

SEQ ID NO: 1456 - DNA, 20 bp, Artificial Sequence
  Description of Artificial Sequence: Synthetic probe
gaactaaggttgcctaaagg

SEQ ID NO: 1457 - DNA, 20 bp, Artificial Sequence
  Description of Artificial Sequence: Synthetic probe
gaaagatttgtatctctgtg

SEQ ID NO: 1458 - DNA, 20 bp, Artificial Sequence
  Description of Artificial Sequence: Synthetic probe
cttgaacttgaatggcctta

SEQ ID NO: 1459 - DNA, 20 bp, Artificial Sequence
  Description of Artificial Sequence: Synthetic probe
aaatcaggaagaagaaagac

SEQ ID NO: 1460 - DNA, 20 bp, Artificial Sequence
  Description of Artificial Sequence: Synthetic probe
ctgaagatcaggaagaagta

SEQ ID NO: 1461 - DNA, 20 bp, Artificial Sequence
  Description of Artificial Sequence: Synthetic probe
cttgcctgaccaccctccag

SEQ ID NO: 1462 - DNA, 20 bp, Artificial Sequence
  Description of Artificial Sequence: Synthetic probe
cagatagacgccggcacccc

SEQ ID NO: 1463 - DNA, 20 bp, Artificial Sequence
  Description of Artificial Sequence: Synthetic probe
cactaaggacattgggcaag

SEQ ID NO: 1464 - DNA, 20 bp, Artificial Sequence
  Description of Artificial Sequence: Synthetic probe
ctagaagaagaacacatggt

SEQ ID NO: 1465 - DNA, 20 bp, Artificial Sequence
  Description of Artificial Sequence: Synthetic probe
ccccgtttcttacaataaat

SEQ ID NO: 1466 - DNA, 20 bp, Artificial Sequence
  Description of Artificial Sequence: Synthetic probe
gttgagtcttagttaagcag

SEQ ID NO: 1467 - DNA, 20 bp, Artificial Sequence
  Description of Artificial Sequence: Synthetic probe
tggtagcatgtcgcagtttc

SEQ ID NO: 1468 - DNA, 20 bp, Artificial Sequence
  Description of Artificial Sequence: Synthetic probe
catgtgtttcaggatcttcg

SEQ ID NO: 1469 - DNA, 20 bp, Artificial Sequence
  Description of Artificial Sequence: Synthetic probe
ccctgactgctagttctgag

SEQ ID NO: 1470 - DNA, 20 bp, Artificial Sequence
  Description of Artificial Sequence: Synthetic probe
gacactggtggctgtgctat

SEQ ID NO: 1471 - DNA, 20 bp, Artificial Sequence
  Description of Artificial Sequence: Synthetic probe
gctgactgggcacactcatg

SEQ ID NO: 1472 - DNA, 20 bp, Artificial Sequence
  Description of Artificial Sequence: Synthetic probe
ccaagtttcagaattattgg

SEQ ID NO: 1473 - DNA, 20 bp, Artificial Sequence
  Description of Artificial Sequence: Synthetic probe
caagtcacacaccctcaaag

SEQ ID NO: 1474 - DNA, 20 bp, Artificial Sequence
  Description of Artificial Sequence: Synthetic probe
ggaagctacacgggccaaat

SEQ ID NO: 1475 - DNA, 20 bp, Artificial Sequence
  Description of Artificial Sequence: Synthetic probe
gggtgagggacagcttactc

SEQ ID NO: 1476 - DNA, 20 bp, Artificial Sequence
  Description of Artificial Sequence: Synthetic probe
catttgaccagattgtttgg

SEQ ID NO: 1477 - DNA, 20 bp, Artificial Sequence
  Description of Artificial Sequence: Synthetic probe
atcctgtcgtgatgtgatag

SEQ ID NO: 1478 - DNA, 20 bp, Artificial Sequence
  Description of Artificial Sequence: Synthetic probe
gagcagcttaacaggcaggg

SEQ ID NO: 1479 - DNA, 20 bp, Artificial Sequence
  Description of Artificial Sequence: Synthetic probe
caaacacaactcttgactgc

SEQ ID NO: 1480 - DNA, 20 bp, Artificial Sequence
  Description of Artificial Sequence: Synthetic probe
cctcccaccctcctacctgt

SEQ ID NO: 1481 - DNA, 20 bp, Artificial Sequence
  Description of Artificial Sequence: Synthetic probe
gcttctggacttacgagaac

SEQ ID NO: 1482 - DNA, 20 bp, Artificial Sequence
  Description of Artificial Sequence: Synthetic probe
agagaggctcttgttgcaaa

SEQ ID NO: 1483 - DNA, 20 bp, Artificial Sequence
  Description of Artificial Sequence: Synthetic probe
gtggctgaattgagaccttg

SEQ ID NO: 1484 - DNA, 20 bp, Artificial Sequence
  Description of Artificial Sequence: Synthetic probe
ctgatgtattcatgtcagca

SEQ ID NO: 1485 - DNA, 20 bp, Artificial Sequence
  Description of Artificial Sequence: Synthetic probe
cctggcatctctgaaccttc

SEQ ID NO: 1486 - DNA, 20 bp, Artificial Sequence
  Description of Artificial Sequence: Synthetic probe
gccccactgacaagcactga

SEQ ID NO: 1487 - DNA, 20 bp, Artificial Sequence
  Description of Artificial Sequence: Synthetic probe
tcatcaggtatctttctgtg

SEQ ID NO: 1488 - DNA, 20 bp, Artificial Sequence
  Description of Artificial Sequence: Synthetic probe
gcatttgagaacagaaacca

SEQ ID NO: 1489 - DNA, 20 bp, Artificial Sequence
  Description of Artificial Sequence: Synthetic probe
tgaagaggagggagactctg

SEQ ID NO: 1490 - DNA, 20 bp, Artificial Sequence
  Description of Artificial Sequence: Synthetic probe
ctgctataactgaggatgag

SEQ ID NO: 1491 - DNA, 20 bp, Artificial Sequence
  Description of Artificial Sequence: Synthetic probe
ggggcagtaccagtccatac

SEQ ID NO: 1492 - DNA, 20 bp, Artificial Sequence
  Description of Artificial Sequence: Synthetic probe
cagctgcgatttgtgagtgg

SEQ ID NO: 1493 - DNA, 20 bp, Artificial Sequence
  Description of Artificial Sequence: Synthetic probe
acttccatgtacaacaaacg

SEQ ID NO: 1494 - DNA, 20 bp, Artificial Sequence
  Description of Artificial Sequence: Synthetic probe
ctccgggaaatggaaagcca

SEQ ID NO: 1495 - DNA, 20 bp, Artificial Sequence
  Description of Artificial Sequence: Synthetic probe
cagttgactggttttgtgtc

SEQ ID NO: 1496 - DNA, 20 bp, Artificial Sequence
  Description of Artificial Sequence: Synthetic probe
ctgtttgaacttgctgaatg

SEQ ID NO: 1497 - DNA, 20 bp, Artificial Sequence
  Description of Artificial Sequence: Synthetic probe
caatgtgaattcctgtgttg

SEQ ID NO: 1498 - DNA, 20 bp, Artificial Sequence
  Description of Artificial Sequence: Synthetic probe
ctaacagaagtggcctgtaa

SEQ ID NO: 1499 - DNA, 20 bp, Artificial Sequence
  Description of Artificial Sequence: Synthetic probe
ccctgcacaccagagacaag

SEQ ID NO: 1500 - DNA, 20 bp, Artificial Sequence
  Description of Artificial Sequence: Synthetic probe
cagagtaacaggatcagtgg

SEQ ID NO: 1501 - DNA, 20 bp, Artificial Sequence
  Description of Artificial Sequence: Synthetic probe
ttgctggcctgttgtaggtg

SEQ ID NO: 1502 - DNA, 20 bp, Artificial Sequence
  Description of Artificial Sequence: Synthetic probe
gtagggacacagatgaccga

SEQ ID NO: 1503 - DNA, 20 bp, Artificial Sequence
  Description of Artificial Sequence: Synthetic probe
ctaaggcatcctaccaacag

SEQ ID NO: 1504 - DNA, 20 bp, Artificial Sequence
  Description of Artificial Sequence: Synthetic probe
caccatcaaggcacgttgga

SEQ ID NO: 1505 - DNA, 20 bp, Artificial Sequence
  Description of Artificial Sequence: Synthetic probe
gaaatagtggcattgcatgc

SEQ ID NO: 1506 - DNA, 20 bp, Artificial Sequence
  Description of Artificial Sequence: Synthetic probe
ccagcaagatcgggccctta

SEQ ID NO: 1507 - DNA, 20 bp, Artificial Sequence
  Description of Artificial Sequence: Synthetic probe
tcagagacaacatccttgtc

SEQ ID NO: 1508 - DNA, 20 bp, Artificial Sequence
  Description of Artificial Sequence: Synthetic probe
catatccaaacccagtgttt

SEQ ID NO: 1509 - DNA, 20 bp, Artificial Sequence
  Description of Artificial Sequence: Synthetic probe
cttttgacctatctgcaatg

SEQ ID NO: 1510 - DNA, 20 bp, Artificial Sequence
  Description of Artificial Sequence: Synthetic probe
cagtgttctcagtaggaaat

SEQ ID NO: 1511 - DNA, 20 bp, Artificial Sequence
  Description of Artificial Sequence: Synthetic probe
ctggttaagatgttcttttc

SEQ ID NO: 1512 - DNA, 20 bp, Artificial Sequence
  Description of Artificial Sequence: Synthetic probe
ctcaaaggtgccctagtgcc

SEQ ID NO: 1513 - DNA, 20 bp, Artificial Sequence
  Description of Artificial Sequence: Synthetic probe
tccctccggactctaaacag

SEQ ID NO: 1514 - DNA, 20 bp, Artificial Sequence
  Description of Artificial Sequence: Synthetic probe
gaacttgaatactgggagag

SEQ ID NO: 1515 - DNA, 20 bp, Artificial Sequence
  Description of Artificial Sequence: Synthetic probe
ggctcagtgagagaatcgcc

SEQ ID NO: 1516 - DNA, 20 bp, Artificial Sequence
  Description of Artificial Sequence: Synthetic probe
cccgtcattggcttaaaatg

SEQ ID NO: 1517 - DNA, 20 bp, Artificial Sequence
  Description of Artificial Sequence: Synthetic probe
ggtggttccttcgtgtgggg

SEQ ID NO: 1518 - DNA, 20 bp, Artificial Sequence
  Description of Artificial Sequence: Synthetic probe
cttgatcgtgttgctgcctg

SEQ ID NO: 1519 - DNA, 20 bp, Artificial Sequence
  Description of Artificial Sequence: Synthetic probe
gtgatagaagagcaaaccac

SEQ ID NO: 1520 - DNA, 20 bp, Artificial Sequence
  Description of Artificial Sequence: Synthetic probe
gtcccacgaatcccaataat

SEQ ID NO: 1521 - DNA, 20 bp, Artificial Sequence
  Description of Artificial Sequence: Synthetic probe
tcttctgactgcaggggaag

SEQ ID NO: 1522 - DNA, 20 bp, Artificial Sequence
  Description of Artificial Sequence: Synthetic probe
gatgtactttccaaacaaat

SEQ ID NO: 1523 - DNA, 20 bp, Artificial Sequence
  Description of Artificial Sequence: Synthetic probe
gaggcaccacgtaagacctc

SEQ ID NO: 1524 - DNA, 20 bp, Artificial Sequence
  Description of Artificial Sequence: Synthetic probe
ctgcccttagctctcttgct

SEQ ID NO: 1525 - DNA, 20 bp, Artificial Sequence
  Description of Artificial Sequence: Synthetic probe
caaagagtatgcctgggagc

SEQ ID NO: 1526 - DNA, 20 bp, Artificial Sequence
  Description of Artificial Sequence: Synthetic probe
ctccagctgttaaaagacaa

SEQ ID NO: 1527 - DNA, 20 bp, Artificial Sequence
  Description of Artificial Sequence: Synthetic probe
gggatcatctgccgtgcctg

SEQ ID NO: 1528 - DNA, 20 bp, Artificial Sequence
  Description of Artificial Sequence: Synthetic probe
gatcctgaaatagaggctaa

SEQ ID NO: 1529 - DNA, 20 bp, Artificial Sequence
  Description of Artificial Sequence: Synthetic probe
tcttggtataaatacacttc

SEQ ID NO: 1530 - DNA, 20 bp, Artificial Sequence
  Description of Artificial Sequence: Synthetic probe
cacagtcagcacggggatca

SEQ ID NO: 1531 - DNA, 20 bp, Artificial Sequence
  Description of Artificial Sequence: Synthetic probe
tcagcaaagctacaggactg

SEQ ID NO: 1532 - DNA, 20 bp, Artificial Sequence
  Description of Artificial Sequence: Synthetic probe
gtactcaagccagcctgtaa

SEQ ID NO: 1533 - DNA, 20 bp, Artificial Sequence
  Description of Artificial Sequence: Synthetic probe
cacacgtatactcagatttg

SEQ ID NO: 1534 - DNA, 20 bp, Artificial Sequence
  Description of Artificial Sequence: Synthetic probe
gcatgtacctttcaacatct

SEQ ID NO: 1535 - DNA, 20 bp, Artificial Sequence
  Description of Artificial Sequence: Synthetic probe
ccccttccctcagcagaaac

SEQ ID NO: 1536 - DNA, 20 bp, Artificial Sequence
  Description of Artificial Sequence: Synthetic probe
gtgtttatcagcaagtcgtg

SEQ ID NO: 1537 - DNA, 20 bp, Artificial Sequence
  Description of Artificial Sequence: Synthetic probe
aagcagtcaatggattcaag

SEQ ID NO: 1538 - DNA, 20 bp, Artificial Sequence
  Description of Artificial Sequence: Synthetic probe
cattctaagctttgttgaca

SEQ ID NO: 1539 - DNA, 20 bp, Artificial Sequence
  Description of Artificial Sequence: Synthetic probe
tattaagaaaatcacatttc

SEQ ID NO: 1540 - DNA, 20 bp, Artificial Sequence
  Description of Artificial Sequence: Synthetic probe
cagggcagcagccgggatcg

SEQ ID NO: 1541 - DNA, 20 bp, Artificial Sequence
  Description of Artificial Sequence: Synthetic probe
cttctcatccttgtctctcc

SEQ ID NO: 1542 - DNA, 20 bp, Artificial Sequence
  Description of Artificial Sequence: Synthetic probe
gcttgtcctcttgtgatgtt

SEQ ID NO: 1543 - DNA, 20 bp, Artificial Sequence
  Description of Artificial Sequence: Synthetic probe
ggaaaagaaagcagatgata

SEQ ID NO: 1544 - DNA, 20 bp, Artificial Sequence
  Description of Artificial Sequence: Synthetic probe
gagaaaaacgacaagaagcc

SEQ ID NO: 1545 - DNA, 20 bp, Artificial Sequence
  Description of Artificial Sequence: Synthetic probe
ttggctcccttgaggttctg

SEQ ID NO: 1546 - DNA, 20 bp, Artificial Sequence
  Description of Artificial Sequence: Synthetic probe
ctagtggtgttaggagtggt

SEQ ID NO: 1547 - DNA, 20 bp, Artificial Sequence
  Description of Artificial Sequence: Synthetic probe
aatatgattatacaaaagag

SEQ ID NO: 1548 - DNA, 20 bp, Artificial Sequence
  Description of Artificial Sequence: Synthetic probe
catggatgcatttcaaatgt

SEQ ID NO: 1549 - DNA, 20 bp, Artificial Sequence
  Description of Artificial Sequence: Synthetic probe
taataaaggctagtcagaac

SEQ ID NO: 1550 - DNA, 20 bp, Artificial Sequence
  Description of Artificial Sequence: Synthetic probe
cctataccataaagtgtagt

SEQ ID NO: 1551 - DNA, 20 bp, Artificial Sequence
  Description of Artificial Sequence: Synthetic probe
gccgttcatgttgctttctc

SEQ ID NO: 1552 - DNA, 20 bp, Artificial Sequence
  Description of Artificial Sequence: Synthetic probe
ctttgtcctcttggacttga

SEQ ID NO: 1553 - DNA, 20 bp, Artificial Sequence
  Description of Artificial Sequence: Synthetic probe
atggagaaataaaccaagag

SEQ ID NO: 1554 - DNA, 20 bp, Artificial Sequence
  Description of Artificial Sequence: Synthetic probe
gagttcattgctattatgac

SEQ ID NO: 1555 - DNA, 20 bp, Artificial Sequence
  Description of Artificial Sequence: Synthetic probe
ggggttgttgtctcattttg

SEQ ID NO: 1556 - DNA, 20 bp, Artificial Sequence
  Description of Artificial Sequence: Synthetic probe
gtctgttttggtcccctccc

SEQ ID NO: 1557 - DNA, 20 bp, Artificial Sequence
  Description of Artificial Sequence: Synthetic probe
tacattgatccacttgagcc

SEQ ID NO: 1558 - DNA, 20 bp, Artificial Sequence
  Description of Artificial Sequence: Synthetic probe
gttaagtgctgccaattgta

SEQ ID NO: 1559 - DNA, 20 bp, Artificial Sequence
  Description of Artificial Sequence: Synthetic probe
agtgccaaaagactattcag

SEQ ID NO: 1560 - DNA, 20 bp, Artificial Sequence
  Description of Artificial Sequence: Synthetic probe
caactggaaactgtcctggg

SEQ ID NO: 1561 - DNA, 20 bp, Artificial Sequence
  Description of Artificial Sequence: Synthetic probe
gtctcgaaggaagcgagaac

SEQ ID NO: 1562 - DNA, 20 bp, Artificial Sequence
  Description of Artificial Sequence: Synthetic probe
gaaatctctcattgtgtgcc

SEQ ID NO: 1563 - DNA, 20 bp, Artificial Sequence
  Description of Artificial Sequence: Synthetic probe
ggagctcaagatgtcttgtg

SEQ ID NO: 1564 - DNA, 20 bp, Artificial Sequence
  Description of Artificial Sequence: Synthetic probe
tctgtgtggctagatggcct

SEQ ID NO: 1565 - DNA, 20 bp, Artificial Sequence
  Description of Artificial Sequence: Synthetic probe
aaattattttaaagtgactg

SEQ ID NO: 1566 - DNA, 20 bp, Artificial Sequence
  Description of Artificial Sequence: Synthetic probe
gaattatctagtccccagat

SEQ ID NO: 1567 - DNA, 20 bp, Artificial Sequence
  Description of Artificial Sequence: Synthetic probe
ggttttagctctgttctctg

SEQ ID NO: 1568 - DNA, 20 bp, Artificial Sequence
  Description of Artificial Sequence: Synthetic probe
ctcccatccttcgctcacca

SEQ ID NO: 1569 - DNA, 20 bp, Artificial Sequence
  Description of Artificial Sequence: Synthetic probe
ccctgggcagtgggttttgg

SEQ ID NO: 1570 - DNA, 20 bp, Artificial Sequence
  Description of Artificial Sequence: Synthetic probe
gcaaattccctttctttgca

SEQ ID NO: 1571 - DNA, 20 bp, Artificial Sequence
  Description of Artificial Sequence: Synthetic probe
gtgatgctgattctgaggac

SEQ ID NO: 1572 - DNA, 20 bp, Artificial Sequence
  Description of Artificial Sequence: Synthetic probe
gatgccgactctgatgatga

SEQ ID NO: 1573 - DNA, 20 bp, Artificial Sequence
  Description of Artificial Sequence: Synthetic probe
tttgtgcacaatgtgatgag

SEQ ID NO: 1574 - DNA, 20 bp, Artificial Sequence
  Description of Artificial Sequence: Synthetic probe
cattccccaccacatcattg

SEQ ID NO: 1575 - DNA, 20 bp, Artificial Sequence
  Description of Artificial Sequence: Synthetic probe
gatttcctgataggctgatg

SEQ ID NO: 1576 - DNA, 20 bp, Artificial Sequence
  Description of Artificial Sequence: Synthetic probe
gcatgtggctgtgactgtga

SEQ ID NO: 1577 - DNA, 20 bp, Artificial Sequence
  Description of Artificial Sequence: Synthetic probe
tgacacagtgttccctcctg

SEQ ID NO: 1578 - DNA, 20 bp, Artificial Sequence
  Description of Artificial Sequence: Synthetic probe
gcagcaattaagggtcttca

SEQ ID NO: 1579 - DNA, 20 bp, Artificial Sequence
  Description of Artificial Sequence: Synthetic probe
agtgattcagctgtttttgg

SEQ ID NO: 1580 - DNA, 20 bp, Artificial Sequence
  Description of Artificial Sequence: Synthetic probe
ctaagggcttttggagctga

SEQ ID NO: 1581 - DNA, 20 bp, Artificial Sequence
  Description of Artificial Sequence: Synthetic probe
agtctagcaagaggacatag

SEQ ID NO: 1582 - DNA, 20 bp, Artificial Sequence
  Description of Artificial Sequence: Synthetic probe
caccctcatctgggaatagg

SEQ ID NO: 1583 - DNA, 20 bp, Artificial Sequence
  Description of Artificial Sequence: Synthetic probe
gctgcatcttttctgttgcc

SEQ ID NO: 1584 - DNA, 20 bp, Artificial Sequence
  Description of Artificial Sequence: Synthetic probe
ccatccaccgccagcttccc

SEQ ID NO: 1585 - DNA, 20 bp, Artificial Sequence
  Description of Artificial Sequence: Synthetic probe
aaggcttctctgccatcctg

SEQ ID NO: 1586 - DNA, 20 bp, Artificial Sequence
  Description of Artificial Sequence: Synthetic probe
gagatcccgttccggctatg

SEQ ID NO: 1587 - DNA, 20 bp, Artificial Sequence
  Description of Artificial Sequence: Synthetic probe
ggcagatagacagagagatg

SEQ ID NO: 1588 - DNA, 20 bp, Artificial Sequence
  Description of Artificial Sequence: Synthetic probe
ctcaacttgtacattgaaaa

SEQ ID NO: 1589 - DNA, 20 bp, Artificial Sequence
  Description of Artificial Sequence: Synthetic probe
ctccaggaagcctgtatcac

SEQ ID NO: 1590 - DNA, 20 bp, Artificial Sequence
  Description of Artificial Sequence: Synthetic probe
ctgtgtaagttggtatttgg

SEQ ID NO: 1591 - DNA, 20 bp, Artificial Sequence
  Description of Artificial Sequence: Synthetic probe
ccgagcctttttgttgctcc

SEQ ID NO: 1592 - DNA, 20 bp, Artificial Sequence
  Description of Artificial Sequence: Synthetic probe
gctcccaggagagtgagggt

SEQ ID NO: 1593 - DNA, 20 bp, Artificial Sequence
  Description of Artificial Sequence: Synthetic probe
ctcggcttggctaccgtgtg

SEQ ID NO: 1594 - DNA, 20 bp, Artificial Sequence
  Description of Artificial Sequence: Synthetic probe
gtagagttatcctactggga

SEQ ID NO: 1595 - DNA, 20 bp, Artificial Sequence
  Description of Artificial Sequence: Synthetic probe
tgttccccaactctgttctg

SEQ ID NO: 1596 - DNA, 20 bp, Artificial Sequence
  Description of Artificial Sequence: Synthetic probe
cgcacgaaacagtatctgtt

SEQ ID NO: 1597 - DNA, 20 bp, Artificial Sequence
  Description of Artificial Sequence: Synthetic probe
gatgtcccgtggaaaatgtg

SEQ ID NO: 1598 - DNA, 20 bp, Artificial Sequence
  Description of Artificial Sequence: Synthetic probe
gccctgaggatgccgtctcc

SEQ ID NO: 1599 - DNA, 20 bp, Artificial Sequence
  Description of Artificial Sequence: Synthetic probe
cctaccccacagctctgttc

SEQ ID NO: 1600 - DNA, 20 bp, Artificial Sequence
  Description of Artificial Sequence: Synthetic probe
catgtaagttgccaacagtt

SEQ ID NO: 1601 - DNA, 20 bp, Artificial Sequence
  Description of Artificial Sequence: Synthetic probe
atggcctctacctttgtatc

SEQ ID NO: 1602 - DNA, 20 bp, Artificial Sequence
  Description of Artificial Sequence: Synthetic probe
caggagaaactgcagagcag

SEQ ID NO: 1603 - DNA, 20 bp, Artificial Sequence
  Description of Artificial Sequence: Synthetic probe
actgggctgtaggggagctg

SEQ ID NO: 1604 - DNA, 20 bp, Artificial Sequence
  Description of Artificial Sequence: Synthetic probe
gactactttagtcttcctaa

SEQ ID NO: 1605 - DNA, 20 bp, Artificial Sequence
  Description of Artificial Sequence: Synthetic probe
catgctggtgcagactgaag

SEQ ID NO: 1606 - DNA, 20 bp, Artificial Sequence
  Description of Artificial Sequence: Synthetic probe
gcaaggagcggagcctgggc

SEQ ID NO: 1607 - DNA, 20 bp, Artificial Sequence
  Description of Artificial Sequence: Synthetic probe
ttgctgccctgtctatcttc

SEQ ID NO: 1608 - DNA, 20 bp, Artificial Sequence
  Description of Artificial Sequence: Synthetic probe
ctggccacagggcttcattc

SEQ ID NO: 1609 - DNA, 20 bp, Artificial Sequence
  Description of Artificial Sequence: Synthetic probe
aggctctggcacaaaacctc

SEQ ID NO: 1610 - DNA, 20 bp, Artificial Sequence
  Description of Artificial Sequence: Synthetic probe
ctcctcccaggcactcattt

SEQ ID NO: 1611 - DNA, 20 bp, Artificial Sequence
  Description of Artificial Sequence: Synthetic probe
gttttttgttccaacagtgg

SEQ ID NO: 1612 - DNA, 20 bp, Artificial Sequence
  Description of Artificial Sequence: Synthetic probe
ccttctccgggcttcatagt

SEQ ID NO: 1613 - DNA, 20 bp, Artificial Sequence
  Description of Artificial Sequence: Synthetic probe
ggaccaattaaaagcaatgg

SEQ ID NO: 1614 - DNA, 20 bp, Artificial Sequence
  Description of Artificial Sequence: Synthetic probe
gcaggagggacccttgctcg

SEQ ID NO: 1615 - DNA, 20 bp, Artificial Sequence
  Description of Artificial Sequence: Synthetic probe
ggctgagggcaagatgggag

SEQ ID NO: 1616 - DNA, 20 bp, Artificial Sequence
  Description of Artificial Sequence: Synthetic probe
gtcagaggtgacagaagcgt

SEQ ID NO: 1617 - DNA, 20 bp, Artificial Sequence
  Description of Artificial Sequence: Synthetic probe
tacaggtgccctattctgag

SEQ ID NO: 1618 - DNA, 20 bp, Artificial Sequence
  Description of Artificial Sequence: Synthetic probe
gtacaggagccgcggctttc

SEQ ID NO: 1619 - DNA, 20 bp, Artificial Sequence
  Description of Artificial Sequence: Synthetic probe
atggagccctgaggcatcag

SEQ ID NO: 1620 - DNA, 20 bp, Artificial Sequence
  Description of Artificial Sequence: Synthetic probe
ctattatacttgggactcta

SEQ ID NO: 1621 - DNA, 20 bp, Artificial Sequence
  Description of Artificial Sequence: Synthetic probe
acaggccctggcaaccttcc

SEQ ID NO: 1622 - DNA, 20 bp, Artificial Sequence
  Description of Artificial Sequence: Synthetic probe
cagtctgtcccatactgtta

SEQ ID NO: 1623 - DNA, 20 bp, Artificial Sequence
  Description of Artificial Sequence: Synthetic probe
tcgacgactcccttcacgtc

SEQ ID NO: 1624 - DNA, 20 bp, Artificial Sequence
  Description of Artificial Sequence: Synthetic probe
caggccacctacatctcggg

SEQ ID NO: 1625 - DNA, 20 bp, Artificial Sequence
  Description of Artificial Sequence: Synthetic probe
catgccctcctgcattgctg

SEQ ID NO: 1626 - DNA, 20 bp, Artificial Sequence
  Description of Artificial Sequence: Synthetic probe
ctgcgtgggtatttgtctcc

SEQ ID NO: 1627 - DNA, 20 bp, Artificial Sequence
  Description of Artificial Sequence: Synthetic probe
gcagtgtatgctcatacttg

SEQ ID NO: 1628 - DNA, 20 bp, Artificial Sequence
  Description of Artificial Sequence: Synthetic probe
gacagttagggaagggtttg

SEQ ID NO: 1629 - DNA, 20 bp, Artificial Sequence
  Description of Artificial Sequence: Synthetic probe
ctctcagagtttctgtgatg

SEQ ID NO: 1630 - DNA, 20 bp, Artificial Sequence
  Description of Artificial Sequence: Synthetic probe
atttgttgagccttgctgga

SEQ ID NO: 1631 - DNA, 20 bp, Artificial Sequence
  Description of Artificial Sequence: Synthetic probe
gcacgctctttaagagtctg

SEQ ID NO: 1632 - DNA, 20 bp, Artificial Sequence
  Description of Artificial Sequence: Synthetic probe
cactggaggaactcctgcca

SEQ ID NO: 1633 - DNA, 20 bp, Artificial Sequence
  Description of Artificial Sequence: Synthetic probe
ctcaaattaccctccaaaag

SEQ ID NO: 1634 - DNA, 20 bp, Artificial Sequence
  Description of Artificial Sequence: Synthetic probe
caagtagccaaagccgttgc

SEQ ID NO: 1635 - DNA, 20 bp, Artificial Sequence
  Description of Artificial Sequence: Synthetic probe
ctgaagaccacagatgcaag

SEQ ID NO: 1636 - DNA, 20 bp, Artificial Sequence
  Description of Artificial Sequence: Synthetic probe
caatgaggaatacagcctgt

SEQ ID NO: 1637 - DNA, 20 bp, Artificial Sequence
  Description of Artificial Sequence: Synthetic probe
ccatattggcccgattagtg

SEQ ID NO: 1638 - DNA, 20 bp, Artificial Sequence
  Description of Artificial Sequence: Synthetic probe
gtactgtctgactcacgtgt

SEQ ID NO: 1639 - DNA, 20 bp, Artificial Sequence
  Description of Artificial Sequence: Synthetic probe
tgtgcaagtgtcattatatc

SEQ ID NO: 1640 - DNA, 20 bp, Artificial Sequence
  Description of Artificial Sequence: Synthetic probe
gaggatgactgtttgctgag

SEQ ID NO: 1641 - DNA, 20 bp, Artificial Sequence
  Description of Artificial Sequence: Synthetic probe
ggagtcaacgtatttcgcag

SEQ ID NO: 1642 - DNA, 20 bp, Artificial Sequence
  Description of Artificial Sequence: Synthetic probe
cgtattacgtaaaatgattt

SEQ ID NO: 1643 - DNA, 20 bp, Artificial Sequence
  Description of Artificial Sequence: Synthetic probe
actatgagcctatagactat

SEQ ID NO: 1644 - DNA, 20 bp, Artificial Sequence
  Description of Artificial Sequence: Synthetic probe
cagttccctttgggcggatt

SEQ ID NO: 1645 - DNA, 20 bp, Artificial Sequence
  Description of Artificial Sequence: Synthetic probe
gaggtgtgggttcctccaac

SEQ ID NO: 1646 - DNA, 20 bp, Artificial Sequence
  Description of Artificial Sequence: Synthetic probe
acaatttgcttctgcccgtt

SEQ ID NO: 1647 - DNA, 20 bp, Artificial Sequence
  Description of Artificial Sequence: Synthetic probe
ccattattctcagtgcctac

SEQ ID NO: 1648 - DNA, 20 bp, Artificial Sequence
  Description of Artificial Sequence: Synthetic probe
cagcgaaagtgcattcagtc

SEQ ID NO: 1649 - DNA, 20 bp, Artificial Sequence
  Description of Artificial Sequence: Synthetic probe
gcccactgtgaaaccactag

SEQ ID NO: 1650 - DNA, 20 bp, Artificial Sequence
  Description of Artificial Sequence: Synthetic probe
gttctaggtcctggcttcta

SEQ ID NO: 1651 - DNA, 20 bp, Artificial Sequence
  Description of Artificial Sequence: Synthetic probe
aggctcagcccaccccaacc

SEQ ID NO: 1652 - DNA, 20 bp, Artificial Sequence
  Description of Artificial Sequence: Synthetic probe
ctatctcatgttcagtctgt

SEQ ID NO: 1653 - DNA, 20 bp, Artificial Sequence
  Description of Artificial Sequence: Synthetic probe
tcaaaccactctgtgaactg

SEQ ID NO: 1654 - DNA, 20 bp, Artificial Sequence
  Description of Artificial Sequence: Synthetic probe
cagcctggagccaaatgtgt

SEQ ID NO: 1655 - DNA, 20 bp, Artificial Sequence
  Description of Artificial Sequence: Synthetic probe
ggcaccgatcaccgagcagc

SEQ ID NO: 1656 - DNA, 20 bp, Artificial Sequence
  Description of Artificial Sequence: Synthetic probe
cgtgcgtgtatctcaaggaa

SEQ ID NO: 1657 - DNA, 20 bp, Artificial Sequence
  Description of Artificial Sequence: Synthetic probe
ggctcagtgaaggaaacatg

SEQ ID NO: 1658 - DNA, 20 bp, Artificial Sequence
  Description of Artificial Sequence: Synthetic probe
cagaaagaatgcctgagacg

SEQ ID NO: 1659 - DNA, 20 bp, Artificial Sequence
  Description of Artificial Sequence: Synthetic probe
tcaatctaaatgcctttcag

SEQ ID NO: 1660 - DNA, 20 bp, Artificial Sequence
  Description of Artificial Sequence: Synthetic probe
gtgggccgcttccttggcta

SEQ ID NO: 1661 - DNA, 20 bp, Artificial Sequence
  Description of Artificial Sequence: Synthetic probe
cagacagaaaaaactgagat

SEQ ID NO: 1662 - DNA, 20 bp, Artificial Sequence
  Description of Artificial Sequence: Synthetic probe
gtagcccctctcctggaagt

SEQ ID NO: 1663 - DNA, 20 bp, Artificial Sequence
  Description of Artificial Sequence: Synthetic probe
gggaaccctcaggtctctag

SEQ ID NO: 1664 - DNA, 20 bp, Artificial Sequence
  Description of Artificial Sequence: Synthetic probe
gtgagggtcttgatgaggac

SEQ ID NO: 1665 - DNA, 20 bp, Artificial Sequence
  Description of Artificial Sequence: Synthetic probe
tagcatgaacttgtgggatg

SEQ ID NO: 1666 - DNA, 20 bp, Artificial Sequence
  Description of Artificial Sequence: Synthetic probe
gtggggttggcttccctggc

SEQ ID NO: 1667 - DNA, 20 bp, Artificial Sequence
  Description of Artificial Sequence: Synthetic probe
ctgccttcagctggtgcttg

SEQ ID NO: 1668 - DNA, 20 bp, Artificial Sequence
  Description of Artificial Sequence: Synthetic probe
ctgcgattcctgtgccttat

SEQ ID NO: 1669 - DNA, 20 bp, Artificial Sequence
  Description of Artificial Sequence: Synthetic probe
gagcggaaccataactcatt

SEQ ID NO: 1670 - DNA, 20 bp, Artificial Sequence
  Description of Artificial Sequence: Synthetic probe
gaattttggagaggaataag

SEQ ID NO: 1671 - DNA, 20 bp, Artificial Sequence
  Description of Artificial Sequence: Synthetic probe
cctggactcaggatgacttg

SEQ ID NO: 1672 - DNA, 20 bp, Artificial Sequence
  Description of Artificial Sequence: Synthetic probe
gaactagggcttggctctca

SEQ ID NO: 1673 - DNA, 20 bp, Artificial Sequence
  Description of Artificial Sequence: Synthetic probe
agcttactgcagcactgttg

SEQ ID NO: 1674 - DNA, 20 bp, Artificial Sequence
  Description of Artificial Sequence: Synthetic probe
gtgttcggagctcttctgtg

SEQ ID NO: 1675 - DNA, 20 bp, Artificial Sequence
  Description of Artificial Sequence: Synthetic probe
ggacctatgcactttatttc

SEQ ID NO: 1676 - DNA, 20 bp, Artificial Sequence
  Description of Artificial Sequence: Synthetic probe
tgaccccgtggcttcggctg

SEQ ID NO: 1677 - DNA, 20 bp, Artificial Sequence
  Description of Artificial Sequence: Synthetic probe
gaagattacgactcctagcg

SEQ ID NO: 1678 - DNA, 20 bp, Artificial Sequence
  Description of Artificial Sequence: Synthetic probe
ccttctgccccccagaccat

SEQ ID NO: 1679 - DNA, 20 bp, Artificial Sequence
  Description of Artificial Sequence: Synthetic probe
ttgtagtaggagctgaaatc

SEQ ID NO: 1680 - DNA, 20 bp, Artificial Sequence
  Description of Artificial Sequence: Synthetic probe
catgctgagctgtaccagga

SEQ ID NO: 1681 - DNA, 20 bp, Artificial Sequence
  Description of Artificial Sequence: Synthetic probe
ttgaaacagatcacagcaac

SEQ ID NO: 1682 - DNA, 20 bp, Artificial Sequence
  Description of Artificial Sequence: Synthetic probe
gacaaacgctcatggcgctg

SEQ ID NO: 1683 - DNA, 20 bp, Artificial Sequence
  Description of Artificial Sequence: Synthetic probe
attgacttgaatatgactag

SEQ ID NO: 1684 - DNA, 20 bp, Artificial Sequence
  Description of Artificial Sequence: Synthetic probe
ccagtttctatgtttttgtt

SEQ ID NO: 1685 - DNA, 20 bp, Artificial Sequence
  Description of Artificial Sequence: Synthetic probe
acagtatgaccgatctctgc

SEQ ID NO: 1686 - DNA, 20 bp, Artificial Sequence
  Description of Artificial Sequence: Synthetic probe
gcctttctgggggcgggcaa

SEQ ID NO: 1687 - DNA, 20 bp, Artificial Sequence
  Description of Artificial Sequence: Synthetic probe
tcctactccggttattgtgg

SEQ ID NO: 1688 - DNA, 20 bp, Artificial Sequence
  Description of Artificial Sequence: Synthetic probe
cctcccacacagccaacaaa

SEQ ID NO: 1689 - DNA, 20 bp, Artificial Sequence
  Description of Artificial Sequence: Synthetic probe
gtccacccaggattagtgac

SEQ ID NO: 1690 - DNA, 20 bp, Artificial Sequence
  Description of Artificial Sequence: Synthetic probe
caggttttcaggaaaggatt

SEQ ID NO: 1691 - DNA, 20 bp, Artificial Sequence
  Description of Artificial Sequence: Synthetic probe
agaaataccgagacattgag

SEQ ID NO: 1692 - DNA, 20 bp, Artificial Sequence
  Description of Artificial Sequence: Synthetic probe
cgactttgaggaatccggct

SEQ ID NO: 1693 - DNA, 20 bp, Artificial Sequence
  Description of Artificial Sequence: Synthetic probe
tgctgcagtgcaacaggagg

SEQ ID NO: 1694 - DNA, 20 bp, Artificial Sequence
  Description of Artificial Sequence: Synthetic probe
ctttttcagtgatcttcact

SEQ ID NO: 1695 - DNA, 20 bp, Artificial Sequence
  Description of Artificial Sequence: Synthetic probe
caggaggaacagtggccttg

SEQ ID NO: 1696 - DNA, 20 bp, Artificial Sequence
  Description of Artificial Sequence: Synthetic probe
cttcttagacggtcttcact

SEQ ID NO: 1697 - DNA, 20 bp, Artificial Sequence
  Description of Artificial Sequence: Synthetic probe
acaagcgcaggtgacctctg

SEQ ID NO: 1698 - DNA, 20 bp, Artificial Sequence
  Description of Artificial Sequence: Synthetic probe
gatcttccttgaaaggggag

SEQ ID NO: 1699 - DNA, 20 bp, Artificial Sequence
  Description of Artificial Sequence: Synthetic probe
ctttgcagctgtctctgctg

SEQ ID NO: 1700 - DNA, 20 bp, Artificial Sequence
  Description of Artificial Sequence: Synthetic probe
caatagttaaagaacttgga

SEQ ID NO: 1701 - DNA, 20 bp, Artificial Sequence
  Description of Artificial Sequence: Synthetic probe
cctttggctttctcttggag

SEQ ID NO: 1702 - DNA, 20 bp, Artificial Sequence
  Description of Artificial Sequence: Synthetic probe
gtgggtcgcagcaccagatg

SEQ ID NO: 1703 - DNA, 20 bp, Artificial Sequence
  Description of Artificial Sequence: Synthetic probe
caaacagcttagatgggagg

SEQ ID NO: 1704 - DNA, 20 bp, Artificial Sequence
  Description of Artificial Sequence: Synthetic probe
ctgaacgtgatgactggcta

SEQ ID NO: 1705 - DNA, 20 bp, Artificial Sequence
  Description of Artificial Sequence: Synthetic probe
tccagccttcactccagctg

SEQ ID NO: 1706 - DNA, 20 bp, Artificial Sequence
  Description of Artificial Sequence: Synthetic probe
gttaaaaatgttgcacttat

SEQ ID NO: 1707 - DNA, 20 bp, Artificial Sequence
  Description of Artificial Sequence: Synthetic probe
aaacctttgcccagaagatg

SEQ ID NO: 1708 - DNA, 20 bp, Artificial Sequence
  Description of Artificial Sequence: Synthetic probe
gatgccttcatgcatgagaa

SEQ ID NO: 1709 - DNA, 20 bp, Artificial Sequence
  Description of Artificial Sequence: Synthetic probe
gtcacagttgaggattttgg

SEQ ID NO: 1710 - DNA, 20 bp, Artificial Sequence
  Description of Artificial Sequence: Synthetic probe
ctgtgatgggctcatactca

SEQ ID NO: 1711 - DNA, 20 bp, Artificial Sequence
  Description of Artificial Sequence: Synthetic probe
gtattgccaaaactgattag

SEQ ID NO: 1712 - DNA, 20 bp, Artificial Sequence
  Description of Artificial Sequence: Synthetic probe
ctagtggacagagatatgcc

SEQ ID NO: 1713 - DNA, 20 bp, Artificial Sequence
  Description of Artificial Sequence: Synthetic probe
gttatgagacgatctcgctg

SEQ ID NO: 1714 - DNA, 20 bp, Artificial Sequence
  Description of Artificial Sequence: Synthetic probe
ggaccgcccctgcccgtgga

SEQ ID NO: 1715 - DNA, 20 bp, Artificial Sequence
  Description of Artificial Sequence: Synthetic probe
aaggccacatccaagacagg

SEQ ID NO: 1716 - DNA, 20 bp, Artificial Sequence
  Description of Artificial Sequence: Synthetic probe
caataatgagcagagtttac

SEQ ID NO: 1717 - DNA, 20 bp, Artificial Sequence
  Description of Artificial Sequence: Synthetic probe
cttggagagcatcaggaagg

SEQ ID NO: 1718 - DNA, 20 bp, Artificial Sequence
  Description of Artificial Sequence: Synthetic probe
cccagctgaaatcagagaat

SEQ ID NO: 1719 - DNA, 20 bp, Artificial Sequence
  Description of Artificial Sequence: Synthetic probe
aagaaggaatgttactttaa

SEQ ID NO: 1720 - DNA, 20 bp, Artificial Sequence
  Description of Artificial Sequence: Synthetic probe
tattggactttgctcatgtg

SEQ ID NO: 1721 - DNA, 20 bp, Artificial Sequence
  Description of Artificial Sequence: Synthetic probe
gtcttcagatacactgtgtc

SEQ ID NO: 1722 - DNA, 20 bp, Artificial Sequence
  Description of Artificial Sequence: Synthetic probe
ctcgatgtgcagaagttgtc

SEQ ID NO: 1723 - DNA, 20 bp, Artificial Sequence
  Description of Artificial Sequence: Synthetic probe
ttttgtgcagatacaacctg

SEQ ID NO: 1724 - DNA, 20 bp, Artificial Sequence
  Description of Artificial Sequence: Synthetic probe
ctctctgtactgctgttgga

SEQ ID NO: 1725 - DNA, 20 bp, Artificial Sequence
  Description of Artificial Sequence: Synthetic probe
ccagtgaaacttacagatgg

SEQ ID NO: 1726 - DNA, 20 bp, Artificial Sequence
  Description of Artificial Sequence: Synthetic probe
gcgagtctttacaccaggtc

SEQ ID NO: 1727 - DNA, 20 bp, Artificial Sequence
  Description of Artificial Sequence: Synthetic probe
ggaaatgttggcagtagatg

SEQ ID NO: 1728 - DNA, 20 bp, Artificial Sequence
  Description of Artificial Sequence: Synthetic probe
ctccaaggagacataaggta

SEQ ID NO: 1729 - DNA, 20 bp, Artificial Sequence
  Description of Artificial Sequence: Synthetic probe
gcatcctctctggggagctg

SEQ ID NO: 1730 - DNA, 20 bp, Artificial Sequence
  Description of Artificial Sequence: Synthetic probe
ctggccgcttagcgttgttt

SEQ ID NO: 1731 - DNA, 20 bp, Artificial Sequence
  Description of Artificial Sequence: Synthetic probe
acccaaacaaagatgttctc

SEQ ID NO: 1732 - DNA, 20 bp, Artificial Sequence
  Description of Artificial Sequence: Synthetic probe
gatacagtctggcaaagact

SEQ ID NO: 1733 - DNA, 20 bp, Artificial Sequence
  Description of Artificial Sequence: Synthetic probe
tggccccaatacccattttg

SEQ ID NO: 1734 - DNA, 20 bp, Artificial Sequence
  Description of Artificial Sequence: Synthetic probe
gaagcccctgtggccgtgtg

SEQ ID NO: 1735 - DNA, 20 bp, Artificial Sequence
  Description of Artificial Sequence: Synthetic probe
actaccagagaacgctgtcc

SEQ ID NO: 1736 - DNA, 20 bp, Artificial Sequence
  Description of Artificial Sequence: Synthetic probe
cccgacatcccactccaaag

SEQ ID NO: 1737 - DNA, 20 bp, Artificial Sequence
  Description of Artificial Sequence: Synthetic probe
aactcccttgtgttccttct

SEQ ID NO: 1738 - DNA, 20 bp, Artificial Sequence
  Description of Artificial Sequence: Synthetic probe
gtgaagaagccctgttctcg

SEQ ID NO: 1739 - DNA, 20 bp, Artificial Sequence
  Description of Artificial Sequence: Synthetic probe
gcatctctctttggcctgag

SEQ ID NO: 1740 - DNA, 20 bp, Artificial Sequence
  Description of Artificial Sequence: Synthetic probe
gttctgtattctgggaaagg

SEQ ID NO: 1741 - DNA, 20 bp, Artificial Sequence
  Description of Artificial Sequence: Synthetic probe
attgaactcattccctgttc

SEQ ID NO: 1742 - DNA, 20 bp, Artificial Sequence
  Description of Artificial Sequence: Synthetic probe
cacaaacccatatgtatcct

SEQ ID NO: 1743 - DNA, 20 bp, Artificial Sequence
  Description of Artificial Sequence: Synthetic probe
ctaggaggactggggtaagc

SEQ ID NO: 1744 - DNA, 20 bp, Artificial Sequence
  Description of Artificial Sequence: Synthetic probe
ggaataaactagagaaggga

SEQ ID NO: 1745 - DNA, 20 bp, Artificial Sequence
  Description of Artificial Sequence: Synthetic probe
gtacctggagacctacaagg

SEQ ID NO: 1746 - DNA, 20 bp, Artificial Sequence
  Description of Artificial Sequence: Synthetic probe
cctatgagcagaaaccagcg

SEQ ID NO: 1747 - DNA, 20 bp, Artificial Sequence
  Description of Artificial Sequence: Synthetic probe
agaggcgggtgaaggagatg

SEQ ID NO: 1748 - DNA, 20 bp, Artificial Sequence
  Description of Artificial Sequence: Synthetic probe
gtgaaggagttcacactgct

SEQ ID NO: 1749 - DNA, 20 bp, Artificial Sequence
  Description of Artificial Sequence: Synthetic probe
tgcagtgtccgttatgagtg

SEQ ID NO: 1750 - DNA, 20 bp, Artificial Sequence
  Description of Artificial Sequence: Synthetic probe
ccaaaaatctgtcttgaagg

SEQ ID NO: 1751 - DNA, 20 bp, Artificial Sequence
  Description of Artificial Sequence: Synthetic probe
tttcccatcctctctctgtg

SEQ ID NO: 1752 - DNA, 20 bp, Artificial Sequence
  Description of Artificial Sequence: Synthetic probe
gaggccaaaccaactctttg

SEQ ID NO: 1753 - DNA, 20 bp, Artificial Sequence
  Description of Artificial Sequence: Synthetic probe
accaaggcaaaatgaattgg

SEQ ID NO: 1754 - DNA, 20 bp, Artificial Sequence
  Description of Artificial Sequence: Synthetic probe
cttctaggggtctgaacctt

SEQ ID NO: 1755 - DNA, 20 bp, Artificial Sequence
  Description of Artificial Sequence: Synthetic probe
tccgtctggtctcctgtttg

SEQ ID NO: 1756 - DNA, 20 bp, Artificial Sequence
  Description of Artificial Sequence: Synthetic probe
caattgcttccctcatctca

SEQ ID NO: 1757 - DNA, 20 bp, Artificial Sequence
  Description of Artificial Sequence: Synthetic probe
ggctgtaaaagcaaaacctc

SEQ ID NO: 1758 - DNA, 20 bp, Artificial Sequence
  Description of Artificial Sequence: Synthetic probe
gtatcagctctggaacaata

SEQ ID NO: 1759 - DNA, 20 bp, Artificial Sequence
  Description of Artificial Sequence: Synthetic probe
cagcagagaaacaaagtctg

SEQ ID NO: 1760 - DNA, 20 bp, Artificial Sequence
  Description of Artificial Sequence: Synthetic probe
gacccactccatgctctgcc

SEQ ID NO: 1761 - DNA, 20 bp, Artificial Sequence
  Description of Artificial Sequence: Synthetic probe
taggacatatggcatgcatg

SEQ ID NO: 1762 - DNA, 20 bp, Artificial Sequence
  Description of Artificial Sequence: Synthetic probe
gtagaaaatgaatgtgaaga

SEQ ID NO: 1763 - DNA, 20 bp, Artificial Sequence
  Description of Artificial Sequence: Synthetic probe
acaaaagctctgtagggctg

SEQ ID NO: 1764 - DNA, 20 bp, Artificial Sequence
  Description of Artificial Sequence: Synthetic probe
cagacatttaaagttcacat

SEQ ID NO: 1765 - DNA, 20 bp, Artificial Sequence
  Description of Artificial Sequence: Synthetic probe
gtccaagctatactgtgcag

SEQ ID NO: 1766 - DNA, 20 bp, Artificial Sequence
  Description of Artificial Sequence: Synthetic probe
gacatggccaggcctggtgg

SEQ ID NO: 1767 - DNA, 20 bp, Artificial Sequence
  Description of Artificial Sequence: Synthetic probe
gctcgaccacctcaacattg

SEQ ID NO: 1768 - DNA, 20 bp, Artificial Sequence
  Description of Artificial Sequence: Synthetic probe
gagacatcacttgccaatgt

SEQ ID NO: 1769 - DNA, 20 bp, Artificial Sequence
  Description of Artificial Sequence: Synthetic probe
tgtcccatcctggacttttc

SEQ ID NO: 1770 - DNA, 20 bp, Artificial Sequence
  Description of Artificial Sequence: Synthetic probe
ctctcatgtctttgctgcag

SEQ ID NO: 1771 - DNA, 20 bp, Artificial Sequence
  Description of Artificial Sequence: Synthetic probe
tctatgctctcgcacctttc

SEQ ID NO: 1772 - DNA, 20 bp, Artificial Sequence
  Description of Artificial Sequence: Synthetic probe
caaagttaacagattttggg

SEQ ID NO: 1773 - DNA, 20 bp, Artificial Sequence
  Description of Artificial Sequence: Synthetic probe
gctggcagaggccatttgtg

SEQ ID NO: 1774 - DNA, 20 bp, Artificial Sequence
  Description of Artificial Sequence: Synthetic probe
gaaagtggagagctacgtgg

SEQ ID NO: 1775 - DNA, 20 bp, Artificial Sequence
  Description of Artificial Sequence: Synthetic probe
gttccctcccccactctaaa

SEQ ID NO: 1776 - DNA, 20 bp, Artificial Sequence
  Description of Artificial Sequence: Synthetic probe
gaccaaggccgtttactcct

SEQ ID NO: 1777 - DNA, 20 bp, Artificial Sequence
  Description of Artificial Sequence: Synthetic probe
ggtggcagtcaccataaaac

SEQ ID NO: 1778 - DNA, 20 bp, Artificial Sequence
  Description of Artificial Sequence: Synthetic probe
aacacatcctgcacctggaa

SEQ ID NO: 1779 - DNA, 20 bp, Artificial Sequence
  Description of Artificial Sequence: Synthetic probe
cggagaagttgcaaatggag

SEQ ID NO: 1780 - DNA, 20 bp, Artificial Sequence
  Description of Artificial Sequence: Synthetic probe
caacagcagcaactgcagca

SEQ ID NO: 1781 - DNA, 20 bp, Artificial Sequence
  Description of Artificial Sequence: Synthetic probe
tcctacgctcacggcgttcc

SEQ ID NO: 1782 - DNA, 20 bp, Artificial Sequence
  Description of Artificial Sequence: Synthetic probe
cctttactcaaatctgggcc

SEQ ID NO: 1783 - DNA, 20 bp, Artificial Sequence
  Description of Artificial Sequence: Synthetic probe
gatagtcctacctcaccctg

SEQ ID NO: 1784 - DNA, 20 bp, Artificial Sequence
  Description of Artificial Sequence: Synthetic probe
gtcaacctacatgatcctta

SEQ ID NO: 1785 - DNA, 20 bp, Artificial Sequence
  Description of Artificial Sequence: Synthetic probe
tttcctagacagagaggcac

SEQ ID NO: 1786 - DNA, 20 bp, Artificial Sequence
  Description of Artificial Sequence: Synthetic probe
ctgggtcagtattagtctat

SEQ ID NO: 1787 - DNA, 20 bp, Artificial Sequence
  Description of Artificial Sequence: Synthetic probe
agctagggctgctgcctcag

SEQ ID NO: 1788 - DNA, 20 bp, Artificial Sequence
  Description of Artificial Sequence: Synthetic probe
ctccaagacaagaatgaacc

SEQ ID NO: 1789 - DNA, 20 bp, Artificial Sequence
  Description of Artificial Sequence: Synthetic probe
tcttttggctgcatagaatg

SEQ ID NO: 1790 - DNA, 20 bp, Artificial Sequence
  Description of Artificial Sequence: Synthetic probe
catgtcaccttgagacggtc

SEQ ID NO: 1791 - DNA, 20 bp, Artificial Sequence
  Description of Artificial Sequence: Synthetic probe
cactaaaatccagactcctg

SEQ ID NO: 1792 - DNA, 20 bp, Artificial Sequence
  Description of Artificial Sequence: Synthetic probe
cagcacccaagcaagttttc

SEQ ID NO: 1793 - DNA, 20 bp, Artificial Sequence
  Description of Artificial Sequence: Synthetic probe
gtggtatgacccaaaggttc

SEQ ID NO: 1794 - DNA, 20 bp, Artificial Sequence
  Description of Artificial Sequence: Synthetic probe
ctctgtgacaaggttggcct

SEQ ID NO: 1795 - DNA, 20 bp, Artificial Sequence
  Description of Artificial Sequence: Synthetic probe
gtctatttattctcgcccag

SEQ ID NO: 1796 - DNA, 20 bp, Artificial Sequence
  Description of Artificial Sequence: Synthetic probe
ctcaccctctacacagacac

SEQ ID NO: 1797 - DNA, 20 bp, Artificial Sequence
  Description of Artificial Sequence: Synthetic probe
accctgctgcccattctttc

SEQ ID NO: 1798 - DNA, 20 bp, Artificial Sequence
  Description of Artificial Sequence: Synthetic probe
caacatcacagatgaactgc

SEQ ID NO: 1799 - DNA, 20 bp, Artificial Sequence
  Description of Artificial Sequence: Synthetic probe
gtagccaaacagtagagatg

SEQ ID NO: 1800 - DNA, 20 bp, Artificial Sequence
  Description of Artificial Sequence: Synthetic probe
gagggccgggaagcaaaccg

SEQ ID NO: 1801 - DNA, 20 bp, Artificial Sequence
  Description of Artificial Sequence: Synthetic probe
tgggtcgctttgcgtttgtc

SEQ ID NO: 1802 - DNA, 20 bp, Artificial Sequence
  Description of Artificial Sequence: Synthetic probe
gaagcctcctctgaatggct

SEQ ID NO: 1803 - DNA, 20 bp, Artificial Sequence
  Description of Artificial Sequence: Synthetic probe
aaacctacatttggacaatg

SEQ ID NO: 1804 - DNA, 20 bp, Artificial Sequence
  Description of Artificial Sequence: Synthetic probe
agaggctgctcctgcggcct

SEQ ID NO: 1805 - DNA, 20 bp, Artificial Sequence
  Description of Artificial Sequence: Synthetic probe
gacaggattctggtgaatgc

SEQ ID NO: 1806 - DNA, 20 bp, Artificial Sequence
  Description of Artificial Sequence: Synthetic probe
gtgctgcccaggaccagtga

SEQ ID NO: 1807 - DNA, 20 bp, Artificial Sequence
  Description of Artificial Sequence: Synthetic probe
agcttattcatagcattgtg

SEQ ID NO: 1808 - DNA, 20 bp, Artificial Sequence
  Description of Artificial Sequence: Synthetic probe
ggtctctccagtaagaaaga

SEQ ID NO: 1809 - DNA, 20 bp, Artificial Sequence
  Description of Artificial Sequence: Synthetic probe
aagctctctggctggaagtc

SEQ ID NO: 1810 - DNA, 20 bp, Artificial Sequence
  Description of Artificial Sequence: Synthetic probe
ctgatactgaatctccagtg

SEQ ID NO: 1811 - DNA, 20 bp, Artificial Sequence
  Description of Artificial Sequence: Synthetic probe
cagaaacccaatctgccatc

SEQ ID NO: 1812 - DNA, 20 bp, Artificial Sequence
  Description of Artificial Sequence: Synthetic probe
gaacaagaaataagaatcct

SEQ ID NO: 1813 - DNA, 20 bp, Artificial Sequence
  Description of Artificial Sequence: Synthetic probe
agaaactagccaagggcaag

SEQ ID NO: 1814 - DNA, 20 bp, Artificial Sequence
  Description of Artificial Sequence: Synthetic probe
ctattattcagcagtgtccc

SEQ ID NO: 1815 - DNA, 20 bp, Artificial Sequence
  Description of Artificial Sequence: Synthetic probe
ctgtcaccacagagattggc

SEQ ID NO: 1816 - DNA, 20 bp, Artificial Sequence
  Description of Artificial Sequence: Synthetic probe
ctacggtttctgttttgagg

SEQ ID NO: 1817 - DNA, 20 bp, Artificial Sequence
  Description of Artificial Sequence: Synthetic probe
gcccaacctctgggaacagg

SEQ ID NO: 1818 - DNA, 20 bp, Artificial Sequence
  Description of Artificial Sequence: Synthetic probe
cagctcctatctgcaaactg

SEQ ID NO: 1819 - DNA, 20 bp, Artificial Sequence
  Description of Artificial Sequence: Synthetic probe
aagtcttacaaagatcaagg

SEQ ID NO: 1820 - DNA, 20 bp, Artificial Sequence
  Description of Artificial Sequence: Synthetic probe
gctgtccgcaacagggaaga

SEQ ID NO: 1821 - DNA, 20 bp, Artificial Sequence
  Description of Artificial Sequence: Synthetic probe
cgttccatgcccaggttaac

SEQ ID NO: 1822 - DNA, 20 bp, Artificial Sequence
  Description of Artificial Sequence: Synthetic probe
aaagaactgtgatatataga

SEQ ID NO: 1823 - DNA, 20 bp, Artificial Sequence
  Description of Artificial Sequence: Synthetic probe
tgcttcatacttgagtgatg

SEQ ID NO: 1824 - DNA, 20 bp, Artificial Sequence
  Description of Artificial Sequence: Synthetic probe
ctggataaggtattgtattt

SEQ ID NO: 1825 - DNA, 20 bp, Artificial Sequence
  Description of Artificial Sequence: Synthetic probe
cgttgaaacacattgattcc

SEQ ID NO: 1826 - DNA, 20 bp, Artificial Sequence
  Description of Artificial Sequence: Synthetic probe
cctccccctacttattgcca

SEQ ID NO: 1827 - DNA, 20 bp, Artificial Sequence
  Description of Artificial Sequence: Synthetic probe
agcagacctcaaggcagaag

SEQ ID NO: 1828 - DNA, 20 bp, Artificial Sequence
  Description of Artificial Sequence: Synthetic probe
ggtcacctaacccaggagtc

SEQ ID NO: 1829 - DNA, 20 bp, Artificial Sequence
  Description of Artificial Sequence: Synthetic probe
acttgaaaaagtggtgtgtg

SEQ ID NO: 1830 - DNA, 20 bp, Artificial Sequence
  Description of Artificial Sequence: Synthetic probe
gttgactctgtttctcgcca

SEQ ID NO: 1831 - DNA, 20 bp, Artificial Sequence
  Description of Artificial Sequence: Synthetic probe
gaggagctgcctgttgtggg

SEQ ID NO: 1832 - DNA, 20 bp, Artificial Sequence
  Description of Artificial Sequence: Synthetic probe
ccagctgcttcgactgctgc

SEQ ID NO: 1833 - DNA, 20 bp, Artificial Sequence
  Description of Artificial Sequence: Synthetic probe
aaaattggcgcctttggacg

SEQ ID NO: 1834 - DNA, 20 bp, Artificial Sequence
  Description of Artificial Sequence: Synthetic probe
ggagatgctgaagcggaaca

SEQ ID NO: 1835 - DNA, 20 bp, Artificial Sequence
  Description of Artificial Sequence: Synthetic probe
acgcacttgttttcatgcag

SEQ ID NO: 1836 - DNA, 20 bp, Artificial Sequence
  Description of Artificial Sequence: Synthetic probe
gagcggggcaagtaaggttg

SEQ ID NO: 1837 - DNA, 20 bp, Artificial Sequence
  Description of Artificial Sequence: Synthetic probe
ccctctcagctctgaggctg

SEQ ID NO: 1838 - DNA, 20 bp, Artificial Sequence
  Description of Artificial Sequence: Synthetic probe
gccgtctttcggggtgttcc

SEQ ID NO: 1839 - DNA, 20 bp, Artificial Sequence
  Description of Artificial Sequence: Synthetic probe
aaaccaggccctgcgtcagg

SEQ ID NO: 1840 - DNA, 20 bp, Artificial Sequence
  Description of Artificial Sequence: Synthetic probe
cagtgtgagtttgccgtttg

SEQ ID NO: 1841 - DNA, 20 bp, Artificial Sequence
  Description of Artificial Sequence: Synthetic probe
atgggtgtccccacccactc

SEQ ID NO: 1842 - DNA, 20 bp, Artificial Sequence
  Description of Artificial Sequence: Synthetic probe
ctcagtgtttgtggagtcga

SEQ ID NO: 1843 - DNA, 20 bp, Artificial Sequence
  Description of Artificial Sequence: Synthetic probe
gccgtgtgttctcacctggg

SEQ ID NO: 1844 - DNA, 20 bp, Artificial Sequence
  Description of Artificial Sequence: Synthetic probe
ctcctgtcgcctcctgcttg

SEQ ID NO: 1845 - DNA, 20 bp, Artificial Sequence
  Description of Artificial Sequence: Synthetic probe
ctgtctgaggaaaatgaatc

SEQ ID NO: 1846 - DNA, 20 bp, Artificial Sequence
  Description of Artificial Sequence: Synthetic probe
cacagctctaccccaggttc

SEQ ID NO: 1847 - DNA, 20 bp, Artificial Sequence
  Description of Artificial Sequence: Synthetic probe
ccctagaaagtaagcccagg

SEQ ID NO: 1848 - DNA, 20 bp, Artificial Sequence
  Description of Artificial Sequence: Synthetic probe
gcttcagatctaagttagtc

SEQ ID NO: 1849 - DNA, 20 bp, Artificial Sequence
  Description of Artificial Sequence: Synthetic probe
tgtgttttaaacagaatttc

SEQ ID NO: 1850 - DNA, 20 bp, Artificial Sequence
  Description of Artificial Sequence: Synthetic probe
gtgaacagccttttatctcc

SEQ ID NO: 1851 - DNA, 20 bp, Artificial Sequence
  Description of Artificial Sequence: Synthetic probe
cctgccagtgtttagaagag

SEQ ID NO: 1852 - DNA, 20 bp, Artificial Sequence
  Description of Artificial Sequence: Synthetic probe
cctgactgtgttcagtgcct

SEQ ID NO: 1853 - DNA, 20 bp, Artificial Sequence
  Description of Artificial Sequence: Synthetic probe
cgctctgacttgtggctcag

SEQ ID NO: 1854 - DNA, 20 bp, Artificial Sequence
  Description of Artificial Sequence: Synthetic probe
gactactttctgggtcgtgc

SEQ ID NO: 1855 - DNA, 20 bp, Artificial Sequence
  Description of Artificial Sequence: Synthetic probe
ctgttgtttgctgccattgg

SEQ ID NO: 1856 - DNA, 20 bp, Artificial Sequence
  Description of Artificial Sequence: Synthetic probe
catgaaatggccaactgtgg

SEQ ID NO: 1857 - DNA, 20 bp, Artificial Sequence
  Description of Artificial Sequence: Synthetic probe
ttttccctggtccaagtatc

SEQ ID NO: 1858 - DNA, 20 bp, Artificial Sequence
  Description of Artificial Sequence: Synthetic probe
ctgtctccggattccagcag

SEQ ID NO: 1859 - DNA, 20 bp, Artificial Sequence
  Description of Artificial Sequence: Synthetic probe
tttagaccttttccctgcac

SEQ ID NO: 1860 - DNA, 20 bp, Artificial Sequence
  Description of Artificial Sequence: Synthetic probe
cactctcttcatcctggggg

SEQ ID NO: 1861 - DNA, 20 bp, Artificial Sequence
  Description of Artificial Sequence: Synthetic probe
agtgtaacggggaccttctg

SEQ ID NO: 1862 - DNA, 20 bp, Artificial Sequence
  Description of Artificial Sequence: Synthetic probe
catacctgtttagaaccaaa

SEQ ID NO: 1863 - DNA, 20 bp, Artificial Sequence
  Description of Artificial Sequence: Synthetic probe
gtttctgaattttaaacttg

SEQ ID NO: 1864 - DNA, 20 bp, Artificial Sequence
  Description of Artificial Sequence: Synthetic probe
ctggattcatgcagccagct

SEQ ID NO: 1865 - DNA, 20 bp, Artificial Sequence
  Description of Artificial Sequence: Synthetic probe
gtttactttttggctggagc

SEQ ID NO: 1866 - DNA, 20 bp, Artificial Sequence
  Description of Artificial Sequence: Synthetic probe
ggagatgaggggccaccccg

SEQ ID NO: 1867 - DNA, 20 bp, Artificial Sequence
  Description of Artificial Sequence: Synthetic probe
ttgtttcctgtcctttgttg

SEQ ID NO: 1868 - DNA, 20 bp, Artificial Sequence
  Description of Artificial Sequence: Synthetic probe
ctcatgctgtttaagtgcag

SEQ ID NO: 1869 - DNA, 20 bp, Artificial Sequence
  Description of Artificial Sequence: Synthetic probe
gaaggatcagtgtagtaatg

SEQ ID NO: 1870 - DNA, 20 bp, Artificial Sequence
  Description of Artificial Sequence: Synthetic probe
ccaggaaagtgctttttacc

SEQ ID NO: 1871 - DNA, 20 bp, Artificial Sequence
  Description of Artificial Sequence: Synthetic probe
ctcatggaccttcaccagac

SEQ ID NO: 1872 - DNA, 20 bp, Artificial Sequence
  Description of Artificial Sequence: Synthetic probe
ctacctcaaagcaccacagc

SEQ ID NO: 1873 - DNA, 20 bp, Artificial Sequence
  Description of Artificial Sequence: Synthetic probe
ggaagaggctcgctcccgcc

SEQ ID NO: 1874 - DNA, 20 bp, Artificial Sequence
  Description of Artificial Sequence: Synthetic probe
catggtcatcactggtctgt

SEQ ID NO: 1875 - DNA, 20 bp, Artificial Sequence
  Description of Artificial Sequence: Synthetic probe
aagaagagcctgaaccacag

SEQ ID NO: 1876 - DNA, 20 bp, Artificial Sequence
  Description of Artificial Sequence: Synthetic probe
gtaccagatgggctgcgagt

SEQ ID NO: 1877 - DNA, 20 bp, Artificial Sequence
  Description of Artificial Sequence: Synthetic probe
agtgtttcgtgaaggtgttg

SEQ ID NO: 1878 - DNA, 20 bp, Artificial Sequence
  Description of Artificial Sequence: Synthetic probe
gagaggggctgtgtctgggt

SEQ ID NO: 1879 - DNA, 20 bp, Artificial Sequence
  Description of Artificial Sequence: Synthetic probe
ccctgcaatgagccaagaac

SEQ ID NO: 1880 - DNA, 20 bp, Artificial Sequence
  Description of Artificial Sequence: Synthetic probe
caacactacatccacctaga

SEQ ID NO: 1881 - DNA, 20 bp, Artificial Sequence
  Description of Artificial Sequence: Synthetic probe
aattccgagataggattatg

SEQ ID NO: 1882 - DNA, 20 bp, Artificial Sequence
  Description of Artificial Sequence: Synthetic probe
cctagtttgtcatatcacag

SEQ ID NO: 1883 - DNA, 20 bp, Artificial Sequence
  Description of Artificial Sequence: Synthetic probe
gagctgggagaggtgctgag

SEQ ID NO: 1884 - DNA, 20 bp, Artificial Sequence
  Description of Artificial Sequence: Synthetic probe
ctaacagtgccaacaagtgc

SEQ ID NO: 1885 - DNA, 20 bp, Artificial Sequence
  Description of Artificial Sequence: Synthetic probe
aaagtgagcctagccaggag

SEQ ID NO: 1886 - DNA, 20 bp, Artificial Sequence
  Description of Artificial Sequence: Synthetic probe
gtgtttggggctctatcgcg

SEQ ID NO: 1887 - DNA, 20 bp, Artificial Sequence
  Description of Artificial Sequence: Synthetic probe
tgcaggtgaaaccaaccagc

SEQ ID NO: 1888 - DNA, 20 bp, Artificial Sequence
  Description of Artificial Sequence: Synthetic probe
cctgtgttagaggaggaaaa

SEQ ID NO: 1889 - DNA, 20 bp, Artificial Sequence
  Description of Artificial Sequence: Synthetic probe
gtcaaggaaatgaataacag

SEQ ID NO: 1890 - DNA, 20 bp, Artificial Sequence
  Description of Artificial Sequence: Synthetic probe
cttgtcagagacttcctatg

SEQ ID NO: 1891 - DNA, 20 bp, Artificial Sequence
  Description of Artificial Sequence: Synthetic probe
agccctgaccccaatgtctg

SEQ ID NO: 1892 - DNA, 20 bp, Artificial Sequence
  Description of Artificial Sequence: Synthetic probe
ctgtttccaacactggtgat

SEQ ID NO: 1893 - DNA, 20 bp, Artificial Sequence
  Description of Artificial Sequence: Synthetic probe
cctggagcagctgctgcagg

SEQ ID NO: 1894 - DNA, 20 bp, Artificial Sequence
  Description of Artificial Sequence: Synthetic probe
cctaccctagagacatggag

SEQ ID NO: 1895 - DNA, 20 bp, Artificial Sequence
  Description of Artificial Sequence: Synthetic probe
ttcctggctgggagtattag

SEQ ID NO: 1896 - DNA, 20 bp, Artificial Sequence
  Description of Artificial Sequence: Synthetic probe
gagatgggagtagagattca

SEQ ID NO: 1897 - DNA, 20 bp, Artificial Sequence
  Description of Artificial Sequence: Synthetic probe
agacaatgaggcattctgtc

SEQ ID NO: 1898 - DNA, 20 bp, Artificial Sequence
  Description of Artificial Sequence: Synthetic probe
ctcctgctgccattcttcat

SEQ ID NO: 1899 - DNA, 20 bp, Artificial Sequence
  Description of Artificial Sequence: Synthetic probe
acaactgttccccaatctac

SEQ ID NO: 1900 - DNA, 20 bp, Artificial Sequence
  Description of Artificial Sequence: Synthetic probe
cagccatctgcaggggtcag

SEQ ID NO: 1901 - DNA, 20 bp, Artificial Sequence
  Description of Artificial Sequence: Synthetic probe
gattgagggtaggaggtttg

SEQ ID NO: 1902 - DNA, 20 bp, Artificial Sequence
  Description of Artificial Sequence: Synthetic probe
gatgggagtgagacagaagt

SEQ ID NO: 1903 - DNA, 20 bp, Artificial Sequence
  Description of Artificial Sequence: Synthetic probe
ctgaaagctgaggatcggag

SEQ ID NO: 1904 - DNA, 20 bp, Artificial Sequence
  Description of Artificial Sequence: Synthetic probe
caagtttctggacgcactta

SEQ ID NO: 1905 - DNA, 20 bp, Artificial Sequence
  Description of Artificial Sequence: Synthetic probe
tctcccagaactggttgcag

SEQ ID NO: 1906 - DNA, 20 bp, Artificial Sequence
  Description of Artificial Sequence: Synthetic probe
ctaaaacagagagatctgac

SEQ ID NO: 1907 - DNA, 20 bp, Artificial Sequence
  Description of Artificial Sequence: Synthetic probe
gagcaagacgggttctcacc

SEQ ID NO: 1908 - DNA, 20 bp, Artificial Sequence
  Description of Artificial Sequence: Synthetic probe
cctgacttctggaggcttcc

SEQ ID NO: 1909 - DNA, 20 bp, Artificial Sequence
  Description of Artificial Sequence: Synthetic probe
cccactttagaagagtccag

SEQ ID NO: 1910 - DNA, 20 bp, Artificial Sequence
  Description of Artificial Sequence: Synthetic probe
gttggtgagcatttagaggg

SEQ ID NO: 1911 - DNA, 20 bp, Artificial Sequence
  Description of Artificial Sequence: Synthetic probe
ttagggaaccttaagtcatg

SEQ ID NO: 1912 - DNA, 20 bp, Artificial Sequence
  Description of Artificial Sequence: Synthetic probe
cagacatgactgttctcttt

SEQ ID NO: 1913 - DNA, 20 bp, Artificial Sequence
  Description of Artificial Sequence: Synthetic probe
agcgggaatttcctacagtg

SEQ ID NO: 1914 - DNA, 20 bp, Artificial Sequence
  Description of Artificial Sequence: Synthetic probe
cccttggttaaattaggcag

SEQ ID NO: 1915 - DNA, 20 bp, Artificial Sequence
  Description of Artificial Sequence: Synthetic probe
agtcggccccatctctcatc

SEQ ID NO: 1916 - DNA, 20 bp, Artificial Sequence
  Description of Artificial Sequence: Synthetic probe
cttttggataagtttctatt

SEQ ID NO: 1917 - DNA, 20 bp, Artificial Sequence
  Description of Artificial Sequence: Synthetic probe
cataatggtacttatcagtg

SEQ ID NO: 1918 - DNA, 20 bp, Artificial Sequence
  Description of Artificial Sequence: Synthetic probe
ccaagcgtccagctcacgag

SEQ ID NO: 1919 - DNA, 20 bp, Artificial Sequence
  Description of Artificial Sequence: Synthetic probe
gtgtggtgctttttctggtc

SEQ ID NO: 1920 - DNA, 20 bp, Artificial Sequence
  Description of Artificial Sequence: Synthetic probe
gcgtggactgtgacagagat

SEQ ID NO: 1921 - DNA, 20 bp, Artificial Sequence
  Description of Artificial Sequence: Synthetic probe
caccctactctttccgtgac

SEQ ID NO: 1922 - DNA, 20 bp, Artificial Sequence
  Description of Artificial Sequence: Synthetic probe
gatgagggcggcaaaaacag

SEQ ID NO: 1923 - DNA, 20 bp, Artificial Sequence
  Description of Artificial Sequence: Synthetic probe
gggtgagaacccaagcgttg

SEQ ID NO: 1924 - DNA, 20 bp, Artificial Sequence
  Description of Artificial Sequence: Synthetic probe
gaactgtagacccgtcctgt

SEQ ID NO: 1925 - DNA, 20 bp, Artificial Sequence
  Description of Artificial Sequence: Synthetic probe
gagaaacctgctggcctctg

SEQ ID NO: 1926 - DNA, 20 bp, Artificial Sequence
  Description of Artificial Sequence: Synthetic probe
cctgttttcatttcccactt

SEQ ID NO: 1927 - DNA, 20 bp, Artificial Sequence
  Description of Artificial Sequence: Synthetic probe
aggctataaatgcagcactg

SEQ ID NO: 1928 - DNA, 20 bp, Artificial Sequence
  Description of Artificial Sequence: Synthetic probe
gctcagagggtcaggaacag

SEQ ID NO: 1929 - DNA, 20 bp, Artificial Sequence
  Description of Artificial Sequence: Synthetic probe
tctttgtttcctggcaatac

SEQ ID NO: 1930 - DNA, 20 bp, Artificial Sequence
  Description of Artificial Sequence: Synthetic probe
gacgtgggaatttcaatgcg

SEQ ID NO: 1931 - DNA, 20 bp, Artificial Sequence
  Description of Artificial Sequence: Synthetic probe
tgatcccttccaatgtggtg

SEQ ID NO: 1932 - DNA, 20 bp, Artificial Sequence
  Description of Artificial Sequence: Synthetic probe
ctagcaggcaggatcccttc

SEQ ID NO: 1933 - DNA, 20 bp, Artificial Sequence
  Description of Artificial Sequence: Synthetic probe
ccgaccccccaagctatttg

SEQ ID NO: 1934 - DNA, 20 bp, Artificial Sequence
  Description of Artificial Sequence: Synthetic probe
ctcacattaacaaattaaag

SEQ ID NO: 1935 - DNA, 20 bp, Artificial Sequence
  Description of Artificial Sequence: Synthetic probe
gagttttagggatgtttgtg

SEQ ID NO: 1936 - DNA, 20 bp, Artificial Sequence
  Description of Artificial Sequence: Synthetic probe
cgggtagactccatcatcca

SEQ ID NO: 1937 - DNA, 20 bp, Artificial Sequence
  Description of Artificial Sequence: Synthetic probe
tgagtcccctccctgccttg

SEQ ID NO: 1938 - DNA, 20 bp, Artificial Sequence
  Description of Artificial Sequence: Synthetic probe
gttaattgactcacaccagc

SEQ ID NO: 1939 - DNA, 20 bp, Artificial Sequence
  Description of Artificial Sequence: Synthetic probe
tgccctagcagaggaaaatg

SEQ ID NO: 1940 - DNA, 20 bp, Artificial Sequence
  Description of Artificial Sequence: Synthetic probe
caacatctcgcaagcgctgc

SEQ ID NO: 1941 - DNA, 20 bp, Artificial Sequence
  Description of Artificial Sequence: Synthetic probe
ccgacttcatctttgccaac

SEQ ID NO: 1942 - DNA, 20 bp, Artificial Sequence
  Description of Artificial Sequence: Synthetic probe
gtcagtgaggcagatgacag

SEQ ID NO: 1943 - DNA, 20 bp, Artificial Sequence
  Description of Artificial Sequence: Synthetic probe
tgctgagaatgtacagtttg

SEQ ID NO: 1944 - DNA, 20 bp, Artificial Sequence
  Description of Artificial Sequence: Synthetic probe
cattaaacatcccaggtctc

SEQ ID NO: 1945 - DNA, 20 bp, Artificial Sequence
  Description of Artificial Sequence: Synthetic probe
gctgtttctcagtcccagag

SEQ ID NO: 1946 - DNA, 20 bp, Artificial Sequence
  Description of Artificial Sequence: Synthetic probe
gccggtggctggttttgaac

SEQ ID NO: 1947 - DNA, 20 bp, Artificial Sequence
  Description of Artificial Sequence: Synthetic probe
ccaagcagcggtcattcaag

SEQ ID NO: 1948 - DNA, 20 bp, Artificial Sequence
  Description of Artificial Sequence: Synthetic probe
acacagatatgcacttatac

SEQ ID NO: 1949 - DNA, 20 bp, Artificial Sequence
  Description of Artificial Sequence: Synthetic probe
tgcctgcagtgcgctctgac

SEQ ID NO: 1950 - DNA, 20 bp, Artificial Sequence
  Description of Artificial Sequence: Synthetic probe
cttctcttcatgtgtgtaaa

SEQ ID NO: 1951 - DNA, 20 bp, Artificial Sequence
  Description of Artificial Sequence: Synthetic probe
tgttctgagtgaacccacag

SEQ ID NO: 1952 - DNA, 20 bp, Artificial Sequence
  Description of Artificial Sequence: Synthetic probe
cagtcgcagaatgagcacct

SEQ ID NO: 1953 - DNA, 20 bp, Artificial Sequence
  Description of Artificial Sequence: Synthetic probe
gggcacctgagggtctgagc

SEQ ID NO: 1954 - DNA, 20 bp, Artificial Sequence
  Description of Artificial Sequence: Synthetic probe
ccccttatgagtacccaaga

SEQ ID NO: 1955 - DNA, 20 bp, Artificial Sequence
  Description of Artificial Sequence: Synthetic probe
aggtcgtagccttttaggtg

SEQ ID NO: 1956 - DNA, 20 bp, Artificial Sequence
  Description of Artificial Sequence: Synthetic probe
gaagaagtgagggtgcagcg

SEQ ID NO: 1957 - DNA, 20 bp, Artificial Sequence
  Description of Artificial Sequence: Synthetic probe
cgaagttctcaccccagctc

SEQ ID NO: 1958 - DNA, 20 bp, Artificial Sequence
  Description of Artificial Sequence: Synthetic probe
ctttgtgtggcaccctgatg

SEQ ID NO: 1959 - DNA, 20 bp, Artificial Sequence
  Description of Artificial Sequence: Synthetic probe
acatggtgtttgtggccttg

SEQ ID NO: 1960 - DNA, 20 bp, Artificial Sequence
  Description of Artificial Sequence: Synthetic probe
gctgacatgaagctgttgtg

SEQ ID NO: 1961 - DNA, 20 bp, Artificial Sequence
  Description of Artificial Sequence: Synthetic probe
cctccagctaggacccagcc

SEQ ID NO: 1962 - DNA, 20 bp, Artificial Sequence
  Description of Artificial Sequence: Synthetic probe
catccccagatgcctgagcc

SEQ ID NO: 1963 - DNA, 20 bp, Artificial Sequence
  Description of Artificial Sequence: Synthetic probe
agtggcccttttggcagcag

SEQ ID NO: 1964 - DNA, 20 bp, Artificial Sequence
  Description of Artificial Sequence: Synthetic probe
gagctcagatacacccatgg

SEQ ID NO: 1965 - DNA, 20 bp, Artificial Sequence
  Description of Artificial Sequence: Synthetic probe
gctgttggaggctttgacag

SEQ ID NO: 1966 - DNA, 20 bp, Artificial Sequence
  Description of Artificial Sequence: Synthetic probe
gaatggactggatcacctga

SEQ ID NO: 1967 - DNA, 20 bp, Artificial Sequence
  Description of Artificial Sequence: Synthetic probe
ggttgcccatgagaagtgtc

SEQ ID NO: 1968 - DNA, 20 bp, Artificial Sequence
  Description of Artificial Sequence: Synthetic probe
cttgttcattttcacccaaa

SEQ ID NO: 1969 - DNA, 20 bp, Artificial Sequence
  Description of Artificial Sequence: Synthetic probe
actctacccacagtgacgtg

SEQ ID NO: 1970 - DNA, 20 bp, Artificial Sequence
  Description of Artificial Sequence: Synthetic probe
gtatctgatgaagacctgat

SEQ ID NO: 1971 - DNA, 20 bp, Artificial Sequence
  Description of Artificial Sequence: Synthetic probe
ctgtggcaccagctaacacg

SEQ ID NO: 1972 - DNA, 20 bp, Artificial Sequence
  Description of Artificial Sequence: Synthetic probe
gatctgagagaagccctgtc

SEQ ID NO: 1973 - DNA, 20 bp, Artificial Sequence
  Description of Artificial Sequence: Synthetic probe
accactgggccataatgttg

SEQ ID NO: 1974 - DNA, 20 bp, Artificial Sequence
  Description of Artificial Sequence: Synthetic probe
cttctcaggctatatgcagt

SEQ ID NO: 1975 - DNA, 20 bp, Artificial Sequence
  Description of Artificial Sequence: Synthetic probe
ggtggttcccactgcatgac

SEQ ID NO: 1976 - DNA, 20 bp, Artificial Sequence
  Description of Artificial Sequence: Synthetic probe
cctctatccctgccatctgt

SEQ ID NO: 1977 - DNA, 20 bp, Artificial Sequence
  Description of Artificial Sequence: Synthetic probe
atttccaatgaagatgtcag

SEQ ID NO: 1978 - DNA, 20 bp, Artificial Sequence
  Description of Artificial Sequence: Synthetic probe
cattttatgaaaaaccagaa

SEQ ID NO: 1979 - DNA, 20 bp, Artificial Sequence
  Description of Artificial Sequence: Synthetic probe
gaagagagaggccaggcgcg

SEQ ID NO: 1980 - DNA, 20 bp, Artificial Sequence
  Description of Artificial Sequence: Synthetic probe
gtggctcacacctgtaatcc

SEQ ID NO: 1981 - DNA, 20 bp, Artificial Sequence
  Description of Artificial Sequence: Synthetic probe
tgggcctctcctgggactac

SEQ ID NO: 1982 - DNA, 20 bp, Artificial Sequence
  Description of Artificial Sequence: Synthetic probe
cagtgtggctcttacgtgtt

SEQ ID NO: 1983 - DNA, 20 bp, Artificial Sequence
  Description of Artificial Sequence: Synthetic probe
agtgggctttgaagtgtgtg

SEQ ID NO: 1984 - DNA, 20 bp, Artificial Sequence
  Description of Artificial Sequence: Synthetic probe
ctgcttactcctttcatctt

SEQ ID NO: 1985 - DNA, 20 bp, Artificial Sequence
  Description of Artificial Sequence: Synthetic probe
ctccaaagcacctaagaatg

SEQ ID NO: 1986 - DNA, 20 bp, Artificial Sequence
  Description of Artificial Sequence: Synthetic probe
gaggtaaagcgaaggattca

SEQ ID NO: 1987 - DNA, 20 bp, Artificial Sequence
  Description of Artificial Sequence: Synthetic probe
tgcagccctgtctacttggg

SEQ ID NO: 1988 - DNA, 20 bp, Artificial Sequence
  Description of Artificial Sequence: Synthetic probe
cacccccaccacctgttagc

SEQ ID NO: 1989 - DNA, 20 bp, Artificial Sequence
  Description of Artificial Sequence: Synthetic probe
tgtcttgttctgtgatgagg

SEQ ID NO: 1990 - DNA, 20 bp, Artificial Sequence
  Description of Artificial Sequence: Synthetic probe
ggaggggggcacatgctgag

SEQ ID NO: 1991 - DNA, 20 bp, Artificial Sequence
  Description of Artificial Sequence: Synthetic probe
cctgccagaaaggaccagtg

SEQ ID NO: 1992 - DNA, 20 bp, Artificial Sequence
  Description of Artificial Sequence: Synthetic probe
ccgtcacatcgctgtctctg

SEQ ID NO: 1993 - DNA, 20 bp, Artificial Sequence
  Description of Artificial Sequence: Synthetic probe
aaccagactgaaaggaatac

SEQ ID NO: 1994 - DNA, 20 bp, Artificial Sequence
  Description of Artificial Sequence: Synthetic probe
ctcagaagagatgcttcatt

SEQ ID NO: 1995 - DNA, 20 bp, Artificial Sequence
  Description of Artificial Sequence: Synthetic probe
gggcagtttaagaagacagc

SEQ ID NO: 1996 - DNA, 20 bp, Artificial Sequence
  Description of Artificial Sequence: Synthetic probe
cagtaacagcaagctgagga

SEQ ID NO: 1997 - DNA, 20 bp, Artificial Sequence
  Description of Artificial Sequence: Synthetic probe
tcccattgcaaacattattc

SEQ ID NO: 1998 - DNA, 20 bp, Artificial Sequence
  Description of Artificial Sequence: Synthetic probe
caagagtatcccagtattag

SEQ ID NO: 1999 - DNA, 20 bp, Artificial Sequence
  Description of Artificial Sequence: Synthetic probe
cgctgtgcatcaaagtgttt

SEQ ID NO: 2000 - DNA, 20 bp, Artificial Sequence
  Description of Artificial Sequence: Synthetic probe
gtatgttcgtagctacatac

SEQ ID NO: 2001 - DNA, 20 bp, Artificial Sequence
  Description of Artificial Sequence: Synthetic probe
gagaaaatccacattcttgg

SEQ ID NO: 2002 - DNA, 20 bp, Artificial Sequence
  Description of Artificial Sequence: Synthetic probe
gctgaacgcgggcctctgac

SEQ ID NO: 2003 - DNA, 20 bp, Artificial Sequence
  Description of Artificial Sequence: Synthetic probe
ccagtctcctctaatgctca

SEQ ID NO: 2004 - DNA, 20 bp, Artificial Sequence
  Description of Artificial Sequence: Synthetic probe
gatttcccatagttggcttt

SEQ ID NO: 2005 - DNA, 20 bp, Artificial Sequence
  Description of Artificial Sequence: Synthetic probe
ggacatgggaaaaaccactg

SEQ ID NO: 2006 - DNA, 20 bp, Artificial Sequence
  Description of Artificial Sequence: Synthetic probe
ctatgccatttcttctctct

SEQ ID NO: 2007 - DNA, 20 bp, Artificial Sequence
  Description of Artificial Sequence: Synthetic probe
tgtggcttttttccaactcc

SEQ ID NO: 2008 - DNA, 20 bp, Artificial Sequence
  Description of Artificial Sequence: Synthetic probe
gtgtgacgtttctgagtgta

SEQ ID NO: 2009 - DNA, 20 bp, Artificial Sequence
  Description of Artificial Sequence: Synthetic probe
gaatcctcctgtggcctctg

SEQ ID NO: 2010 - DNA, 20 bp, Artificial Sequence
  Description of Artificial Sequence: Synthetic probe
cttgtacagaactgggaaac

SEQ ID NO: 2011 - DNA, 20 bp, Artificial Sequence
  Description of Artificial Sequence: Synthetic probe
cgggctggcattttgtgacc

SEQ ID NO: 2012 - DNA, 20 bp, Artificial Sequence
  Description of Artificial Sequence: Synthetic probe
cttccctgttgctgtccctg

SEQ ID NO: 2013 - DNA, 20 bp, Artificial Sequence
  Description of Artificial Sequence: Synthetic probe
ctgtggtggctccccctctg

SEQ ID NO: 2014 - DNA, 20 bp, Artificial Sequence
  Description of Artificial Sequence: Synthetic probe
cttctcggggtccagtgcat

SEQ ID NO: 2015 - DNA, 20 bp, Artificial Sequence
  Description of Artificial Sequence: Synthetic probe
ctgacgagctgcccgaggtg

SEQ ID NO: 2016 - DNA, 20 bp, Artificial Sequence
  Description of Artificial Sequence: Synthetic probe
gataacctgacactggacgg

SEQ ID NO: 2017 - DNA, 20 bp, Artificial Sequence
  Description of Artificial Sequence: Synthetic probe
aagtgagaaacagtgctctg

SEQ ID NO: 2018 - DNA, 20 bp, Artificial Sequence
  Description of Artificial Sequence: Synthetic probe
gtgacatgataaatatatgt

SEQ ID NO: 2019 - DNA, 20 bp, Artificial Sequence
  Description of Artificial Sequence: Synthetic probe
gtttctggttctcaactccc

SEQ ID NO: 2020 - DNA, 20 bp, Artificial Sequence
  Description of Artificial Sequence: Synthetic probe
ggtccctgaatagtcacacg

SEQ ID NO: 2021 - DNA, 20 bp, Artificial Sequence
  Description of Artificial Sequence: Synthetic probe
ggcagatggtgggacctatg

SEQ ID NO: 2022 - DNA, 20 bp, Artificial Sequence
  Description of Artificial Sequence: Synthetic probe
cagcttgtgtgaatgcagcc

SEQ ID NO: 2023 - DNA, 20 bp, Artificial Sequence
  Description of Artificial Sequence: Synthetic probe
gaaagggtcaaataagagac

SEQ ID NO: 2024 - DNA, 20 bp, Artificial Sequence
  Description of Artificial Sequence: Synthetic probe
ctggaaaacgaacaagagag

SEQ ID NO: 2025 - DNA, 20 bp, Artificial Sequence
  Description of Artificial Sequence: Synthetic probe
tcgaaagagaaatggaaatc

SEQ ID NO: 2026 - DNA, 20 bp, Artificial Sequence
  Description of Artificial Sequence: Synthetic probe
ccttgacatctgctacctcc

SEQ ID NO: 2027 - DNA, 20 bp, Artificial Sequence
  Description of Artificial Sequence: Synthetic probe
aagctaaagaaggttgtgag

SEQ ID NO: 2028 - DNA, 20 bp, Artificial Sequence
  Description of Artificial Sequence: Synthetic probe
gcttgcccgggttcgagatc

SEQ ID NO: 2029 - DNA, 20 bp, Artificial Sequence
  Description of Artificial Sequence: Synthetic probe
ccctcggtttattcgagtcc

SEQ ID NO: 2030 - DNA, 20 bp, Artificial Sequence
  Description of Artificial Sequence: Synthetic probe
gtgaagacaagcagccggag

SEQ ID NO: 2031 - DNA, 20 bp, Artificial Sequence
  Description of Artificial Sequence: Synthetic probe
cggaaaggtttggcctgacg

SEQ ID NO: 2032 - DNA, 20 bp, Artificial Sequence
  Description of Artificial Sequence: Synthetic probe
ctggagtgcggtgatgaact

SEQ ID NO: 2033 - DNA, 20 bp, Artificial Sequence
  Description of Artificial Sequence: Synthetic probe
tggatttattgtttttattc

SEQ ID NO: 2034 - DNA, 20 bp, Artificial Sequence
  Description of Artificial Sequence: Synthetic probe
cacacttcctacttggtctc

SEQ ID NO: 2035 - DNA, 20 bp, Artificial Sequence
  Description of Artificial Sequence: Synthetic probe
ctggctgcctgttccctgtg

SEQ ID NO: 2036 - DNA, 20 bp, Artificial Sequence
  Description of Artificial Sequence: Synthetic probe
ctcttcagaattactgtttt

SEQ ID NO: 2037 - DNA, 20 bp, Artificial Sequence
  Description of Artificial Sequence: Synthetic probe
aagtctgagtgaaaggatgg

SEQ ID NO: 2038 - DNA, 20 bp, Artificial Sequence
  Description of Artificial Sequence: Synthetic probe
cctcattctctttctaatct

SEQ ID NO: 2039 - DNA, 20 bp, Artificial Sequence
  Description of Artificial Sequence: Synthetic probe
agacctacctcaggttgctg

SEQ ID NO: 2040 - DNA, 20 bp, Artificial Sequence
  Description of Artificial Sequence: Synthetic probe
gttgctgtgtggtttggtgt

SEQ ID NO: 2041 - DNA, 20 bp, Artificial Sequence
  Description of Artificial Sequence: Synthetic probe
gttctgtggtcaggcggcac

SEQ ID NO: 2042 - DNA, 20 bp, Artificial Sequence
  Description of Artificial Sequence: Synthetic probe
caatgagaaaggaatgcaga

SEQ ID NO: 2043 - DNA, 20 bp, Artificial Sequence
  Description of Artificial Sequence: Synthetic probe
agctgcacaacctctttatg

SEQ ID NO: 2044 - DNA, 20 bp, Artificial Sequence
  Description of Artificial Sequence: Synthetic probe
ctggatattgtaaccatgag

SEQ ID NO: 2045 - DNA, 20 bp, Artificial Sequence
  Description of Artificial Sequence: Synthetic probe
taaaccaacagctcacaaag

SEQ ID NO: 2046 - DNA, 20 bp, Artificial Sequence
  Description of Artificial Sequence: Synthetic probe
gagaaagagcactaccaggt

SEQ ID NO: 2047 - DNA, 20 bp, Artificial Sequence
  Description of Artificial Sequence: Synthetic probe
cccatcctaatttttatcac

SEQ ID NO: 2048 - DNA, 20 bp, Artificial Sequence
  Description of Artificial Sequence: Synthetic probe
ctgaaggttggaaccagtga

SEQ ID NO: 2049 - DNA, 20 bp, Artificial Sequence
  Description of Artificial Sequence: Synthetic probe
tcaaagagattcgaatgacg

SEQ ID NO: 2050 - DNA, 20 bp, Artificial Sequence
  Description of Artificial Sequence: Synthetic probe
gtaagtgttctcatgaagca

SEQ ID NO: 2051 - DNA, 20 bp, Artificial Sequence
  Description of Artificial Sequence: Synthetic probe
tgtgcttcctgcagctcacg

SEQ ID NO: 2052 - DNA, 20 bp, Artificial Sequence
  Description of Artificial Sequence: Synthetic probe
cccaccagctactgaaggga

SEQ ID NO: 2053 - DNA, 20 bp, Artificial Sequence
  Description of Artificial Sequence: Synthetic probe
cagcttttttgtctcctttg

SEQ ID NO: 2054 - DNA, 20 bp, Artificial Sequence
  Description of Artificial Sequence: Synthetic probe
ggtattcacaacagccaggg

SEQ ID NO: 2055 - DNA, 20 bp, Artificial Sequence
  Description of Artificial Sequence: Synthetic probe
tctccactttcacccgcagg

SEQ ID NO: 2056 - DNA, 20 bp, Artificial Sequence
  Description of Artificial Sequence: Synthetic probe
ccttaccgctctgtttatag

SEQ ID NO: 2057 - DNA, 20 bp, Artificial Sequence
  Description of Artificial Sequence: Synthetic probe
caacaacattcccagcagac

SEQ ID NO: 2058 - DNA, 20 bp, Artificial Sequence
  Description of Artificial Sequence: Synthetic probe
caactcccaccccctctttg

SEQ ID NO: 2059 - DNA, 20 bp, Artificial Sequence
  Description of Artificial Sequence: Synthetic probe
ttccctaaccctaattgatg

SEQ ID NO: 2060 - DNA, 20 bp, Artificial Sequence
  Description of Artificial Sequence: Synthetic probe
agaggctcgctgcttgatgg

SEQ ID NO: 2061 - DNA, 20 bp, Artificial Sequence
  Description of Artificial Sequence: Synthetic probe
tttagtacagctatctgctg

SEQ ID NO: 2062 - DNA, 20 bp, Artificial Sequence
  Description of Artificial Sequence: Synthetic probe
gctctaaaccttctacgcct

SEQ ID NO: 2063 - DNA, 20 bp, Artificial Sequence
  Description of Artificial Sequence: Synthetic probe
tgatcccattttcctctgac

SEQ ID NO: 2064 - DNA, 20 bp, Artificial Sequence
  Description of Artificial Sequence: Synthetic probe
gtccacctcctaccccatag

SEQ ID NO: 2065 - DNA, 20 bp, Artificial Sequence
  Description of Artificial Sequence: Synthetic probe
tcccattagagatgtatcac

SEQ ID NO: 2066 - DNA, 20 bp, Artificial Sequence
  Description of Artificial Sequence: Synthetic probe
caccttgtcaccaacaggat

SEQ ID NO: 2067 - DNA, 20 bp, Artificial Sequence
  Description of Artificial Sequence: Synthetic probe
gaccctctttgaattaagtg

SEQ ID NO: 2068 - DNA, 20 bp, Artificial Sequence
  Description of Artificial Sequence: Synthetic probe
gactgtggcatgacattctg

SEQ ID NO: 2069 - DNA, 20 bp, Artificial Sequence
  Description of Artificial Sequence: Synthetic probe
catgcagtgagcacatctag

SEQ ID NO: 2070 - DNA, 20 bp, Artificial Sequence
  Description of Artificial Sequence: Synthetic probe
ctgacgataatcacaccttt

SEQ ID NO: 2071 - DNA, 20 bp, Artificial Sequence
  Description of Artificial Sequence: Synthetic probe
ggcagtggaaacaccagata

SEQ ID NO: 2072 - DNA, 20 bp, Artificial Sequence
  Description of Artificial Sequence: Synthetic probe
gaagatcttaggagaggccc

SEQ ID NO: 2073 - DNA, 20 bp, Artificial Sequence
  Description of Artificial Sequence: Synthetic probe
tagctgattgttcccacttg

SEQ ID NO: 2074 - DNA, 20 bp, Artificial Sequence
  Description of Artificial Sequence: Synthetic probe
cacctctccacctttggcac

SEQ ID NO: 2075 - DNA, 20 bp, Artificial Sequence
  Description of Artificial Sequence: Synthetic probe
acaaccctgaagacaacaag

SEQ ID NO: 2076 - DNA, 20 bp, Artificial Sequence
  Description of Artificial Sequence: Synthetic probe
gaaagaaaccatgaaagtct

SEQ ID NO: 2077 - DNA, 20 bp, Artificial Sequence
  Description of Artificial Sequence: Synthetic probe
tcaggccaattactgtggag

SEQ ID NO: 2078 - DNA, 20 bp, Artificial Sequence
  Description of Artificial Sequence: Synthetic probe
cagctttcattcctacccac

SEQ ID NO: 2079 - DNA, 20 bp, Artificial Sequence
  Description of Artificial Sequence: Synthetic probe
tagatcacaggcaccagttg

SEQ ID NO: 2080 - DNA, 20 bp, Artificial Sequence
  Description of Artificial Sequence: Synthetic probe
gtcttcagggacctcatagc

SEQ ID NO: 2081 - DNA, 20 bp, Artificial Sequence
  Description of Artificial Sequence: Synthetic probe
tggccacctcaatcaccagc

SEQ ID NO: 2082 - DNA, 20 bp, Artificial Sequence
  Description of Artificial Sequence: Synthetic probe
caagatggttgctttgtcca

SEQ ID NO: 2083 - DNA, 20 bp, Artificial Sequence
  Description of Artificial Sequence: Synthetic probe
gacaccagccctgtcctagc

SEQ ID NO: 2084 - DNA, 20 bp, Artificial Sequence
  Description of Artificial Sequence: Synthetic probe
ccttcagtaagaccttgcca

SEQ ID NO: 2085 - DNA, 20 bp, Artificial Sequence
  Description of Artificial Sequence: Synthetic probe
atgctctgtagattgagttg

SEQ ID NO: 2086 - DNA, 20 bp, Artificial Sequence
  Description of Artificial Sequence: Synthetic probe
ctggaggagtgacagccagg

SEQ ID NO: 2087 - DNA, 20 bp, Artificial Sequence
  Description of Artificial Sequence: Synthetic probe
aacgtcagcatgatcaactg

SEQ ID NO: 2088 - DNA, 20 bp, Artificial Sequence
  Description of Artificial Sequence: Synthetic probe
gaggctcagaagctggaata

SEQ ID NO: 2089 - DNA, 20 bp, Artificial Sequence
  Description of Artificial Sequence: Synthetic probe
gtaaattcagggccccattg

SEQ ID NO: 2090 - DNA, 20 bp, Artificial Sequence
  Description of Artificial Sequence: Synthetic probe
ctacttatgccatatttgga

SEQ ID NO: 2091 - DNA, 20 bp, Artificial Sequence
  Description of Artificial Sequence: Synthetic probe
ttctctgccccgtttcttgc

SEQ ID NO: 2092 - DNA, 20 bp, Artificial Sequence
  Description of Artificial Sequence: Synthetic probe
cccagtgtggtttgcattgt

SEQ ID NO: 2093 - DNA, 20 bp, Artificial Sequence
  Description of Artificial Sequence: Synthetic probe
cttgattcacttagaagtgt

SEQ ID NO: 2094 - DNA, 20 bp, Artificial Sequence
  Description of Artificial Sequence: Synthetic probe
ctcagaaaacctggacagtt

SEQ ID NO: 2095 - DNA, 20 bp, Artificial Sequence
  Description of Artificial Sequence: Synthetic probe
ggtctagtgtgttcttagtg

SEQ ID NO: 2096 - DNA, 20 bp, Artificial Sequence
  Description of Artificial Sequence: Synthetic probe
gttatactgggaagtgtgtg

SEQ ID NO: 2097 - DNA, 20 bp, Artificial Sequence
  Description of Artificial Sequence: Synthetic probe
ggaatgtactttcacttttg

SEQ ID NO: 2098 - DNA, 20 bp, Artificial Sequence
  Description of Artificial Sequence: Synthetic probe
ctgcttcactgccttgtgct

SEQ ID NO: 2099 - DNA, 20 bp, Artificial Sequence
  Description of Artificial Sequence: Synthetic probe
caaccaaggccagtagaaag

SEQ ID NO: 2100 - DNA, 20 bp, Artificial Sequence
  Description of Artificial Sequence: Synthetic probe
ctatggctgcaaaaccctgg

SEQ ID NO: 2101 - DNA, 20 bp, Artificial Sequence
  Description of Artificial Sequence: Synthetic probe
atgaactgagatcataaagg

SEQ ID NO: 2102 - DNA, 20 bp, Artificial Sequence
  Description of Artificial Sequence: Synthetic probe
gcaactgatgtgtgaagaaa

SEQ ID NO: 2103 - DNA, 20 bp, Artificial Sequence
  Description of Artificial Sequence: Synthetic probe
acctgagacactgtggctgt

SEQ ID NO: 2104 - DNA, 20 bp, Artificial Sequence
  Description of Artificial Sequence: Synthetic probe
ctaatgtaatcctttaaaaa

SEQ ID NO: 2105 - DNA, 20 bp, Artificial Sequence
  Description of Artificial Sequence: Synthetic probe
gccaacctttcccccaccag

SEQ ID NO: 2106 - DNA, 20 bp, Artificial Sequence
  Description of Artificial Sequence: Synthetic probe
ctaaggacatttcccagggt

SEQ ID NO: 2107 - DNA, 20 bp, Artificial Sequence
  Description of Artificial Sequence: Synthetic probe
agaaagtagctttgtgacat

SEQ ID NO: 2108 - DNA, 20 bp, Artificial Sequence
  Description of Artificial Sequence: Synthetic probe
gtcatgaacccatgtttgca

SEQ ID NO: 2109 - DNA, 20 bp, Artificial Sequence
  Description of Artificial Sequence: Synthetic probe
acccctagctcacctcctac

SEQ ID NO: 2110 - DNA, 20 bp, Artificial Sequence
  Description of Artificial Sequence: Synthetic probe
tgtaaagagaatgcactggt

SEQ ID NO: 2111 - DNA, 20 bp, Artificial Sequence
  Description of Artificial Sequence: Synthetic probe
ggcaaggatgtgcctgagtg

SEQ ID NO: 2112 - DNA, 20 bp, Artificial Sequence
  Description of Artificial Sequence: Synthetic probe
caaaactcagtagactcctc

SEQ ID NO: 2113 - DNA, 20 bp, Artificial Sequence
  Description of Artificial Sequence: Synthetic probe
gcattttgcatgccattctc

SEQ ID NO: 2114 - DNA, 20 bp, Artificial Sequence
  Description of Artificial Sequence: Synthetic probe
catcagatctgggatgatgg

SEQ ID NO: 2115 - DNA, 20 bp, Artificial Sequence
  Description of Artificial Sequence: Synthetic probe
ctagcgcttaaggagctctg

SEQ ID NO: 2116 - DNA, 20 bp, Artificial Sequence
  Description of Artificial Sequence: Synthetic probe
cctggcgctgggcgaagaat

SEQ ID NO: 2117 - DNA, 20 bp, Artificial Sequence
  Description of Artificial Sequence: Synthetic probe
ggccatccccataccttctg

SEQ ID NO: 2118 - DNA, 20 bp, Artificial Sequence
  Description of Artificial Sequence: Synthetic probe
gtttgaaggcgctgacactg

SEQ ID NO: 2119 - DNA, 20 bp, Artificial Sequence
  Description of Artificial Sequence: Synthetic probe
ggacacttactcaacagaag

SEQ ID NO: 2120 - DNA, 20 bp, Artificial Sequence
  Description of Artificial Sequence: Synthetic probe
cacctttaggcgaaggaaca

SEQ ID NO: 2121 - DNA, 20 bp, Artificial Sequence
  Description of Artificial Sequence: Synthetic probe
ttcttgggagcgtgaggcag

SEQ ID NO: 2122 - DNA, 20 bp, Artificial Sequence
  Description of Artificial Sequence: Synthetic probe
gaagacactaggtgctgaat

SEQ ID NO: 2123 - DNA, 20 bp, Artificial Sequence
  Description of Artificial Sequence: Synthetic probe
ttactgaccccaccacacac

SEQ ID NO: 2124 - DNA, 20 bp, Artificial Sequence
  Description of Artificial Sequence: Synthetic probe
cggaccaccaagagagccag

SEQ ID NO: 2125 - DNA, 20 bp, Artificial Sequence
  Description of Artificial Sequence: Synthetic probe
gccagcactcgcctccctac

SEQ ID NO: 2126 - DNA, 20 bp, Artificial Sequence
  Description of Artificial Sequence: Synthetic probe
caatgactcacctgaagtgc

SEQ ID NO: 2127 - DNA, 20 bp, Artificial Sequence
  Description of Artificial Sequence: Synthetic probe
gttttcagggagcctgttag

SEQ ID NO: 2128 - DNA, 20 bp, Artificial Sequence
  Description of Artificial Sequence: Synthetic probe
gtgcctccttcttttctttc

SEQ ID NO: 2129 - DNA, 20 bp, Artificial Sequence
  Description of Artificial Sequence: Synthetic probe
tggccattaacttagcagtg

SEQ ID NO: 2130 - DNA, 20 bp, Artificial Sequence
  Description of Artificial Sequence: Synthetic probe
ggacctcacttttacaagca

SEQ ID NO: 2131 - DNA, 20 bp, Artificial Sequence
  Description of Artificial Sequence: Synthetic probe
aaagaagaggcgtgggaatc

SEQ ID NO: 2132 - DNA, 20 bp, Artificial Sequence
  Description of Artificial Sequence: Synthetic probe
caggcagtggtttttccttt

SEQ ID NO: 2133 - DNA, 20 bp, Artificial Sequence
  Description of Artificial Sequence: Synthetic probe
gtggcctcgacatcaaactg

SEQ ID NO: 2134 - DNA, 20 bp, Artificial Sequence
  Description of Artificial Sequence: Synthetic probe
cctggatttttctaccaccc

SEQ ID NO: 2135 - DNA, 20 bp, Artificial Sequence
  Description of Artificial Sequence: Synthetic probe
ccaggacgtgcctcatacat

SEQ ID NO: 2136 - DNA, 20 bp, Artificial Sequence
  Description of Artificial Sequence: Synthetic probe
gacttgagcttgtcagtcca

SEQ ID NO: 2137 - DNA, 20 bp, Artificial Sequence
  Description of Artificial Sequence: Synthetic probe
gtctttgcaatgtattgaag

SEQ ID NO: 2138 - DNA, 20 bp, Artificial Sequence
  Description of Artificial Sequence: Synthetic probe
gaattgctgccgtgtgagtt

SEQ ID NO: 2139 - DNA, 20 bp, Artificial Sequence
  Description of Artificial Sequence: Synthetic probe
ttcagccagggacaaaatcc

SEQ ID NO: 2140 - DNA, 20 bp, Artificial Sequence
  Description of Artificial Sequence: Synthetic probe
cctcccaaaccactctccac

SEQ ID NO: 2141 - DNA, 20 bp, Artificial Sequence
  Description of Artificial Sequence: Synthetic probe
gctaccagcgtgcatgtcag

SEQ ID NO: 2142 - DNA, 20 bp, Artificial Sequence
  Description of Artificial Sequence: Synthetic probe
cgaccctggcccgacaggcc

SEQ ID NO: 2143 - DNA, 20 bp, Artificial Sequence
  Description of Artificial Sequence: Synthetic probe
ctggaaagctgaagactgtc

SEQ ID NO: 2144 - DNA, 20 bp, Artificial Sequence
  Description of Artificial Sequence: Synthetic probe
gcctgctccgaatttccgtc

SEQ ID NO: 2145 - DNA, 20 bp, Artificial Sequence
  Description of Artificial Sequence: Synthetic probe
taggaggagaatacttgaag

SEQ ID NO: 2146 - DNA, 20 bp, Artificial Sequence
  Description of Artificial Sequence: Synthetic probe
cagtatgctgctgtggttag

SEQ ID NO: 2147 - DNA, 20 bp, Artificial Sequence
  Description of Artificial Sequence: Synthetic probe
gctttgttcccaatgacatg

SEQ ID NO: 2148 - DNA, 20 bp, Artificial Sequence
  Description of Artificial Sequence: Synthetic probe
caagttggacagacgggaaa

SEQ ID NO: 2149 - DNA, 20 bp, Artificial Sequence
  Description of Artificial Sequence: Synthetic probe
cactgctcaatacagcctcc

SEQ ID NO: 2150 - DNA, 20 bp, Artificial Sequence
  Description of Artificial Sequence: Synthetic probe
gatcctcactcttgaaagct

SEQ ID NO: 2151 - DNA, 20 bp, Artificial Sequence
  Description of Artificial Sequence: Synthetic probe
tcacatgtggaccttgatac

SEQ ID NO: 2152 - DNA, 20 bp, Artificial Sequence
  Description of Artificial Sequence: Synthetic probe
gactaagcggttacatatgt

SEQ ID NO: 2153 - DNA, 20 bp, Artificial Sequence
  Description of Artificial Sequence: Synthetic probe
tggctactcactttggcaag

SEQ ID NO: 2154 - DNA, 20 bp, Artificial Sequence
  Description of Artificial Sequence: Synthetic probe
gagttcacccctgaagtgca

SEQ ID NO: 2155 - DNA, 20 bp, Artificial Sequence
  Description of Artificial Sequence: Synthetic probe
tggagtgtgtggtagcaatg

SEQ ID NO: 2156 - DNA, 20 bp, Artificial Sequence
  Description of Artificial Sequence: Synthetic probe
catcaagctcagcttatctc

SEQ ID NO: 2157 - DNA, 20 bp, Artificial Sequence
  Description of Artificial Sequence: Synthetic probe
caactcactgtctgcagctg

SEQ ID NO: 2158 - DNA, 20 bp, Artificial Sequence
  Description of Artificial Sequence: Synthetic probe
cctgtctggtgtctgtcttt

SEQ ID NO: 2159 - DNA, 20 bp, Artificial Sequence
  Description of Artificial Sequence: Synthetic probe
gctctgaagattcccagaag

SEQ ID NO: 2160 - DNA, 20 bp, Artificial Sequence
  Description of Artificial Sequence: Synthetic probe
ccacaaggattgaagggaaa

SEQ ID NO: 2161 - DNA, 20 bp, Artificial Sequence
  Description of Artificial Sequence: Synthetic probe
gacgtctgtggccaagcgag

SEQ ID NO: 2162 - DNA, 20 bp, Artificial Sequence
  Description of Artificial Sequence: Synthetic probe
gtctcaggtgcaaagcaaaa

SEQ ID NO: 2163 - DNA, 20 bp, Artificial Sequence
  Description of Artificial Sequence: Synthetic probe
tcgtctgaaagaggaagcag

SEQ ID NO: 2164 - DNA, 20 bp, Artificial Sequence
  Description of Artificial Sequence: Synthetic probe
ctatgaaggccaaaacagag

SEQ ID NO: 2165 - DNA, 20 bp, Artificial Sequence
  Description of Artificial Sequence: Synthetic probe
aaccagccttgggagtattg

SEQ ID NO: 2166 - DNA, 20 bp, Artificial Sequence
  Description of Artificial Sequence: Synthetic probe
actggtcccttacctcttat

SEQ ID NO: 2167 - DNA, 20 bp, Artificial Sequence
  Description of Artificial Sequence: Synthetic probe
gcactaccagactgacatgg

SEQ ID NO: 2168 - DNA, 20 bp, Artificial Sequence
  Description of Artificial Sequence: Synthetic probe
ccagtacagaggagaactag

SEQ ID NO: 2169 - DNA, 20 bp, Artificial Sequence
  Description of Artificial Sequence: Synthetic probe
ctggagctttcctgatgatg

SEQ ID NO: 2170 - DNA, 20 bp, Artificial Sequence
  Description of Artificial Sequence: Synthetic probe
ctggccctacagtaccccca

What is claimed is:

1. A method for making a transcriptome-wide expression profile of a biological sample, said method consisting essentially of:
   a) measuring simultaneously the expression levels of a selected group of approximately 500 to approximately 1000 centroid genes set forth in Table 3, wherein said measuring comprises ligation-mediated amplification;
   b) determining the expression levels of unmeasured non-centroid genes and unmeasured non-selected centroid genes from the measured expression levels obtain in step (a);
   c) combining the results of steps (a) and (b) to produce a transcriptome-wide expression profile; and
   d) providing the transcriptome-wide expression profile as output data, wherein the biological sample comprises a plurality of centroid transcripts and non-centroid transcripts, and wherein the transcriptome consists of centroid transcripts and non-centroid transcripts.

2. The method according to claim 1, wherein the selection of centroid genes to be measured is provided by
   a) performing computational analysis on a library of transcriptome-wide transcript expression data, such that a plurality of transcript clusters is created, wherein the number of said clusters is less than the total number of transcripts in the library;
   b) identifying a centroid transcript and non-centroid transcripts within each of said transcript clusters wherein each centroid transcript is the expression from a respective centroid gene and each non-centroid transcript is the expression from a respective non-centroid gene and wherein
   the measured expression levels of said centroid gene facilitates the calculation of the levels of at least a portion of transcripts from said non-centroid genes; and
   c) selecting said centroid genes whose said expression levels facilitate the calculation of the levels of said portion of unmeasured, non-centroid transcripts.

3. The method according to claim 2, wherein said computational analysis includes cluster analysis.

4. The method of claim 2, wherein said method further comprises repeating the steps thereof until validated centroid transcripts for each of said plurality of transcript clusters are identified.

5. The method according to claim 1, wherein expression levels are measured on a device selected from the group consisting of a microarray, a bead array, a liquid array, and a nucleic-acid sequencer.

6. The method according to claim 5, wherein said method steps include:
   a) performing computational analysis on a first library of transcriptome-wide mRNA expression data from a first collection of biological samples, such that a plurality of transcript clusters is created, wherein the number of said clusters is less than the total number of transcripts in the library;
   b) identifying a centroid transcript and non-centroid transcripts within each of said transcript clusters, wherein each centroid transcript is the expression from a respective centroid gene and each non-centroid transcript is the expression from a respective non-centroid gene;
   c) measuring the levels of at least a portion of transcripts from a second collection of biological samples with said device, wherein said portion of transcripts comprises transcripts identified as centroid transcripts from the first library;
   d) determining if said measured expression levels of said centroid genes facilitates the calculation of the levels of at least a portion of transcripts from said second library, wherein said portion is comprised of non-centroid transcripts; and
   e) selecting said centroid genes whose said expression levels facilitate the calculation of the levels of said portion of unmeasured, non-centroid transcripts.

7. The method according to claim 6, wherein the expression levels of non-centroid genes are determined by:
   applying an algorithm to said measured expression level of the selected centroid genes of Table 3 in step (a), wherein the algorithm facilitates the calculation of the level of the non-centroid transcripts that are not measured.

8. The method according to claim 7, wherein said algorithm involves a dependency matrix.

9. The method of claim 7 wherein said measured transcripts consist of 1000 different sample transcripts that are the 1000 centroid transcripts set forth in Table 3.

10. The method of claim 6, wherein said method further comprises repeating the steps for providing the centroid transcripts until validated centroid transcripts for each of said plurality of transcript clusters are identified.

11. The method according to claim 1, wherein said measured transcripts are expressed from approximately 1000 selected centroid genes set forth in Table 3.

12. The method according to claim 11, wherein said method further comprises determining similarity between said determined transcriptome-wide expression profile and expression profiles of diseased and normal cells or tissues, to further identify said biological sample as diseased or as healthy.

13. The method according to claim 11, wherein said transcriptome-wide expression profile provides a functional readout of the action of a perturbagen.

14. The method according to claim 11, wherein said biological sample comprises cultured human cells treated with a plurality of perturbagens, and said method further comprises repeatedly performing the method with different biological samples to obtain a plurality of transcriptome-wide expression profiles, and populating a database with the plurality of transcriptome-wide gene-expression profiles.

15. The method according to claim 11, wherein said method further comprises measuring expression levels of substantially invariant transcripts.

16. The method according to claim 15, wherein said measured expression levels are normalized with respect to said expression levels of said substantially invariant transcripts.

17. The method according to claim 1, wherein said method further comprises establishing a correlation between said expression levels of the selected group of centroid genes and said expression levels of said non-centroid genes.

18. The method according to claim 1, wherein the expression levels of non-centroid genes are determined by:
   applying an algorithm to said measured expression level of the selected centroid genes of Table 3 in step (a), wherein the algorithm facilitates the calculation of the level of the non-centroid transcripts that are not measured transcripts within said second population.

19. The method according to claim 18, wherein said algorithm involves a dependency matrix.

20. The method according to claim 1, wherein said method further comprises determining similarity between said determined transcriptome-wide expression profile and expression profiles of diseased and normal cells or tissues to characterize said biological sample as diseased or as healthy.

21. The method according to claim 1, wherein said transcriptome-wide expression profile provides a functional readout of the action of a perturbagen.

22. The method according to claim 1, wherein said biological sample comprises cultured human cells treated with a plurality of perturbagens, and said method steps include repeatedly performing the method with different biological samples to obtain a plurality of transcriptome-wide expression profiles, and populating a database with the plurality of transcriptome-wide gene-expression profiles.

23. The method according to claim 22, wherein said method further comprises analyzing the database populated with the plurality of transcriptome-wide gene expression profiles against another gene-expression profile or database of gene-expression profiles for similarities.

24. The method according to claim 1, wherein said method further comprises measuring levels of substantially invariant transcripts.

25. The method according to claim 24, wherein said measured levels of the centroid transcripts are normalized with respect to said levels of said substantially invariant transcripts.

26. The method of claim 1 wherein said ligation mediated amplification comprises using probe pairs for each of the sample transcripts that are centroid transcripts, obtaining and fluorescence labeling amplicons, detecting fluorescence, and associating median fluorescence intensity values for each transcript.

27. The method according to claim 26, wherein the expression levels of non-centroid genes are determined by:
applying an algorithm to said measured expression level of the selected centroid genes of Table 3 in step (a), wherein the algorithm facilitates the calculation of the level of the non-centroid transcripts that is not measured.

28. The method according to claim 27, wherein said algorithm involves a dependency matrix.

29. The method according to claim 27, wherein the expression levels of non-centroid genes are determined by:
applying an algorithm to said plurality of measurements, wherein the algorithm facilitates the calculation of the level of the non-centroid transcripts that is not measured.

30. The method according to claim 1, wherein said measured transcripts are from approximately 700 selected centroid genes set forth in Table 3.

31. The method according to claim 30, wherein the expression levels of non-centroid genes are determined by:
applying an algorithm to said measured expression level of the selected centroid genes of Table 3 in step (a), wherein the algorithm facilitates the calculation of the level of the non-centroid transcripts that are not measured transcripts within said second population, and the measured.

32. A method according to claim 31, wherein said algorithm involves a dependency matrix.

33. The method according to claim 30, wherein the method further comprises determining similarity between said determined transcriptome-wide expression profile and expression profiles of diseased and normal cells or tissues, to further identify said biological sample as diseased or as healthy.

34. A method according to claim 30, wherein said transcriptome-wide expression profile provides a functional readout of the action of a perturbagen.

35. A method according to claim 30, wherein said biological sample comprises cultured human cells treated with a plurality of perturbagens, and said method steps include repeatedly performing the method with different biological samples to obtain a plurality of transcriptome-wide expression profiles, and populating a database with the plurality of transcriptome-wide gene-expression profiles.

36. A method according to claim 30, wherein said method further comprises measuring levels of substantially invariant transcripts.

37. A method according to claim 36, wherein said measured levels are normalized with respect to said levels of said substantially invariant transcripts.

38. The method of claim 30, wherein, said measuring includes oligonucleotide probes which detect at least RNA or cDNA transcripts.

39. The method of claim 1, wherein said measured transcripts consist of 1000 different sample transcripts that are the 1000 centroid transcripts set forth in Table 3.

40. The method of claim 1, wherein said measuring includes amplifying said measured sample transcripts.

41. The method of claim 1, wherein said measuring includes oligonucleotide probes which detect RNA or cDNA transcripts.

42. The method of claim 1, wherein the dataset is stored in a database, is displayed in a format for interpretation, is transmitted to a computer, or is used to generate a report.

43. A method for making a transcriptome-wide expression profile of a biological sample said method comprising:
a) measuring simultaneously the expression levels of a selected group approximately 500 to approximately 1000 centroid genes set forth in Table 3, wherein the measuring comprises detecting the measured transcripts using ligation-mediated amplification, optically-addressed and barcoded microspheres, and flow cytometry;
b) determining the expression levels of unmeasured non-centroid genes and unmeasured non-selected centroid genes from the measured expression levels obtain in step (a);
c) combining the results of steps (a) and (b) to produce a transcriptome-wide expression profile; and
d) providing the transcriptome-wide expression profile as output data, wherein the biological sample comprises a plurality of transcripts of centroid transcripts and non-centroid transcripts, and wherein the transcriptome consists of centroid transcripts and non-centroid transcripts.

44. The method of claim 43, wherein, said measuring includes oligonucleotide probes which detect at least RNA or cDNA transcripts.

45. A method for making a transcriptome-wide expression profile of a biological sample without having to measure all the transcripts in the biological sample, said method comprising:
(a) measuring simultaneously the expression levels of a selected group of approximately 500 to approximately 1000 selected centroid genes set forth in Table 3, wherein the measuring comprises contacting the sample with at least one probe,
(b) measuring the expression levels of a set of substantially invariant genes in said biological sample,
(c) normalizing said measured expression levels of the selected centroid genes with respect to said expression levels of said substantially invariant genes, (d) determining the expression levels of unmeasured non-centroid genes and unmeasured non-selected centroid genes from the measured expression levels obtain in step (c);

(e) combining the results of steps (c) and (d) to produce a transcriptome-wide expression profile; and (f) providing the transcriptome-wide expression profile as a dataset, wherein the biological sample comprises a plurality of transcripts consisting essentially of centroid transcripts and non-centroid transcripts, and wherein the transcriptome consists of centroid transcripts and non-centroid transcripts.

46. The method of claim 45, wherein the set of substantially invariant genes measured is between 10 and 50 invariant genes.

47. The method of claim 45, wherein the set of substantially invariant genes measured is between 14 and 98 invariant genes.

48. The method of claim 45, wherein 80 invariant genes are measured.

49. The method of claim 45, wherein the set of substantially invariant genes are for quality control.

* * * * *